United States Patent 9,556,238 (MAGNETOSOME GENE EXPRESSION IN EUKARYOTIC CELLS) - sequence listing, part 3

SEQ ID NO: 2 - DNA, 4967148 bp, Magnetospirillum magneticum (residues 3,311,433-4,967,148 of 4,967,148)
  misc_feature (1356851)..(1356852): n is a, c, g, or t
  misc_feature (1380785)..(1380785): n is a, c, g, or t
  misc_feature (2155828)..(2155829): n is a, c, g, or t
  misc_feature (2156370)..(2156371): n is a, c, g, or t
  misc_feature (2157178)..(2157179): n is a, c, g, or t
  misc_feature (2157382)..(2157382): n is a, c, g, or t
  misc_feature (2157945)..(2157946): n is a, c, g, or t
  misc_feature (2158187)..(2158190): n is a, c, g, or t
  misc_feature (2160013)..(2160014): n is a, c, g, or t
  misc_feature (2162065)..(2162066): n is a, c, g, or t
  misc_feature (2162569)..(2162570): n is a, c, g, or t
  misc_feature (2164009)..(2164010): n is a, c, g, or t
  misc_feature (2356104)..(2356104): n is a, c, g, or t
  misc_feature (2473942)..(2473942): n is a, c, g, or t
  misc_feature (4631788)..(4631788): n is a, c, g, or t
gcgccaaacggtccagagcgtcggttccgctcattcctcattcccctcgatttcatctcgccgcaatccgcgcataccgcccgaacggcgcaaaaccgccagggaacgctgccccagcggataggtgatccccgccgcccaatgagtccccgcatggcggccggcgggatcgttggtatcaagcaccagttcccacgaccgccccaggctgggcggcggcagcacatagggtaccgcctcgtgataggcgttgagcagcaccaggaaggtgtcgtccatctcttcgtgccccgtgaggttgtccacggcgcaggattcgccccccagcacgaagcccagcgagcgggcgaagggcgtggtccagtcggcatggcccatctcgcgcccctcgggcgtcacccagacgatgtccttcaggggcgagttgggcaggcgcttgccctcgaaaaagcggggacggcggaacaccggatgggccttgcgcagcgcgatcaggccctgcacgaaggccagcaggtcctcgtccacctgatcccaggcgacccagcccagttcattgtcctggcaataggcgttgttgttgcccttctgcgaccgccccatctcgtcgccggccagcagcatgggaatgccctgggacagcagcagggtggccagcagattgcggctctgccgtgccctcagcgccgtgatctcgggatagggcgacggtccctcgtgaccgcaattccaggcgtaattggcgtcggtgccgtccttgttggcctcgagattggcctcgttgtgcttgcgctcgtaggtcaccaggtccttgagggtgaaaccgtcgtggcaggtgacgaagttcaagctggcccagggccgccgcccgccccagccgaagatgtcgcttgatccggtcaggcgcgaggccagatcgccgatcaccccgccctcccccgtccagaagcgccgcaccgtgtcgcggtagcggccgttccactcggaccagccggggggaaagcgcccgacccgatagccgtctccccctaagtcccaaggctcggcgatcagcttcagccgggacagcaccgggtcctggcgcaccgcgtcgaggaagccggaggtatggtcgaagccgcccttgccccgcaccagcgacgccgccagatcgaagcggaagccgtccacgtgcatctcctcggcccaatagcgcaaggaatccatcaccatctgcagcacgcggggatgggcgaggttcaaggtattgccgcagcccgagtaattctcgtaccagcgcttgccgtccggccccaggcggtaatagctgagattgtcgatgccgcgataggacagcgtcggccccaggtgattgccctcggcggtgtggttgtagaccacgtccagaatcacctcgatgcccacgtcgtgcagccgcgacaccatggtcttgaagtcgccgtgcgggctggcggaataatagcgggcatcgggggcgaaaaagccgatggaattgtagccccagtaattgcgcatgccccggtcggccagatgcttctcgtcgatcatggcgtggatgggcagcaattgcagcgtggtcacccccagacgccgcaggtggtcgatcacgccgggctgggtcagacccaggaaggtgccgcgcatgccgttgaccacgccgggatgcttcatggtcatgccgcgcacatgggcctcgtagacgatggtctcgggccacggcacgttggggcggcggtcatcaccccaggtgaaggcggtatcgatcacccggcacttgggcatgaagcgggcgttgtcgcgcttgtcggccaccaggtccagcttcggcgtgcccggcttgaagccgaaatgggtgtccgaccattcgaagctgccggcatgagccttggcatagggatcgagcagcagcttgtgggcgttgaagcgatggccctcgttggggtcgtaggggccgtggacgcgatagccgtaaagctggcccggccggcaatcgggcagatagccgtgccagacctcgtcagtgtattcgggcagggcgatgcgctccacctcgcgcaggccgcgccggtcgaacaggcacagctccaccttctcggcatgggccgagaacagggcgaagttcacgccattgccgtcccaggtcgccccaagaggattggccgagccgggaagaatgcggcgatgggaggtcatgcgggcctcaaacggaaattgtccttcgcttgtaccgcattaccgctcccgcttgaacacgcaggtggccaacggcggcagccgcaggcagatggagaagccgtggccgtgccagggcacctcctcggtgtgaactccgccgccgttatggatgttggcgccgccataccattcggaatcggtgttgagcagctcgcggtaccatccaggctcgggcacgccgatgcgataggagtcgcgcaccatgggagtgtaattgcccgccaccaccaggaagtcgccgggatcgaagcccttgcgcagccaggtcagaaccgaattgtcgcggtcgttgcagtcgatccaggcaaagcccgccggctcattgtccaactggtgcagcgctggctcggtgcggtacaggcggttcaggtcgcggatcaggcgcatgacgccttcgttgcgcccgtcgcccagcaggtgccagtccaggctggcatcctcgttccactcgctttgctgggcgaattcctggcccatgaacagcagcttcttgcccggctgggtccacatgaagccgtaataggcgcgcagattggcaaagcgctgccagggatcgcccggcatgcggccgaagatcgaacccttgccgtgcaccacctcgtcgtgggacagcggcagcacgaaattctcgtgataggcatagagctgggcgaaggtcaggctgtcatggtgatagcggcggtggatggggtccttggagaagtagcgcagcgtgtcgtgcatccaccccatgttccacttgtagccgaagcccagcccgcccagatgcaccggccgcgagaccatgggccaggcggtggattcctcggcaatggtcatggcgcccggatgctcggcatagaccagcatgttcatgcggcgcaggaagtcgatggcttccagattctcgttaccgccgtggcggttgggaatccactcgcccggctcgcgcgagtaatccaggtacagcatggacgccaccgcatccacgcgcaggccgtccacgtgatactgctccagccagtacagggcgttggcgtagagatagttcaccacttcgctgcggccgtaattgtagatcagggtgttccagtccttgtgcacgcccaggcgcgggtcctcgtgctcgtagagatgggtgccgtcgaaatggtgcaggccgtggggatcgttggggaaatgcccggccacccagtcgatgatcacgccgatgcccttttggtgcaggcgatcgaccagggtgcggaactcgtccggcgtgccgtagcgcgaggtgggcgcgaacagccccaccggctgatagccccacgagccgccgaagggatgctcgtgaatgggcaggaactccacatgggtgaagcccaggtcggccacgtaatcgcccagctggtcggccatttcgagataggacagcggccggttgcaatcttccggcacgcgccgccacgaccccagatgcacctcatagatgctgatgggggcatggcggtcattgcgcgccttctgcgccgccatccagtcggcatcggcccagtcgcggcggcccagttcccacaccaccgaggcggtcttgggcggcacctcggcgaaatggccgtaagggtcggccttcaggggcagcagccgcccgtcggaggcgacgatttcatatttgtagacggccccctgccccaggccgggaatgaagatttcccacattcccgcctcatggcgcaggcgcataggatggcgccgcccgtcccagccgttaaagtcgcccaccaccgaaacgcgggaggcattgggcgcccacagggcgaagtcgaccccggccaccccgtcgacaatccgaacctgggcgccgagcttctcgaaggtccgcaggtgggtcccctcggccagcaggtggacgtcgagatcgcccagcaccggggggaagcgataggggtcgtccagttcttcggtcccgccgtcatggcgcaccgcccgcagccggtaggcgggcgaacccttcagcttgacagcgaacaggccgtcggggtgagcccggctcatctcggtctcgccatcggcggccagcacgaagaccgttcgggcctggggctggaaggtacggatcaccgtgccgcccttgaccgcatggggacccagcacggcgaagggatcgccatgacgtccccgggcgatggcatcggcatcgctggaccggatcaatttcgccgcttcgggcatcagccccctcctgccagtcgaagatcccaagtgtcaccgcctttggccggaaagacaaagggcgatttcacaacggacgttttacgggggctgctttttaattggattgattggaccttccgcaaagcccctaaatctggtagtagatcagcgtgaggggatcggcctgattcgcccgacaaggcaagaccgggccgattagacaattcgtgcagcccgtcgggggcggcaccgcaaattcatggagcgtgttatgggcgtccttccgaaggttctgggtcttaccgttgccggcgttacggtcatcgctctgtatctggccgtttccgtgctgagcgccttgttcggcggcgtcgccgatccgagcccggcccacagcccgctcggtttcgccgtgtatctgggcctggcgctgaccgccgtgttcaccagcatcgtgatgtacctggcctcgaccggcggcggctccgcgcagagctaagccggttcgccacgaacctcaaagcgccccggcctcgcggccggggcgctttcatttcaaggccgggatcaggctgtccgcacgctggtcaggaattcccgcacctcgctttccaggcgggcgctctcgtccagcaggccgttggccgaggtgaacaccgcctgggccatgccgccggtttccgaggcagcctgggcgacgccggcgatattgcgggccacctcgctggtgccttcgttggccagttccacgttgcgggcgatttccgccgtggcggcgccttgctcctcgaccgccccagcgatggccgtcgccagctcattgatgcgcgagatggtatgggaaatgcccgagatggcctcgaccgccgcctgggtttccgcctgcaccgcagagatctgcaaggtgatctcctccgtggccttggccgtctgtccagccagattcttgacctcgtgcgccaccacggcgaatcccttgccggcgtcgccggcccgggcgctttcgatggtggcgttcagggccagtaggttggtctggctggcgatgtcgctgatcagcttgaccacgttgccaatccgctgcgccgcctcggccatgccggtgaccttgcgcgtcgcctccatgacctcggtctcggcggcctgggcgatgtccgaggactgacggacctgccgcgagatctcgtggatggaactggccagttccgtgctggctgaggccacggtccccacattggccgtcgcctcgtcggtggcggtcgagacggcgctgctctggcgctgggtctgctcggcattggccgacaaggtgtcggccgaaccatgcagcgcttgaacggcggccttgacccggctcagggtggtctcgatggattggtcgaaacgctgggtcgccacctcgatgacctgctgacgggcctcgcgctgggtccgggccaggcgctcctcctccgcccgggcggcggcctccatgatgctgctccgccagccgttcagggcctgggcaagcggcccgaactcgtcgcggcgctccacgcccggcacggccaagccggtatcgcctccggccagacgacgcaccgcccccaccagatcccccaggggattggtgatgctgcgaccgatggccagggcgagaaccagaccgaagacggtagccagcaatccgacgatgacggacaggcggctgaccagggcgatcaggctttcaacctgggccgcctcggcatcggaggtggcgcgatagccctcggacaggctggcgccgatcttgtcgatggccgcgctgatctttccggcgtcactgcgggacgccgccagttctggatcatcgaaggccgcctttcgcgccctcaattcgctgagcttctcgaccctgaccttgtaggcggcgatcagctcggccatctcgcgcacctgccgctgacgctccggcgcgaagagggtggcggcatgcagcgcctcgacctccttgatcagatcgttcgtcagggaaattcccttctgcaggcggctggtgtcgtcggtgccgaaatacacccagatattgaagcgcgcctcgtagatgtgccgctcgatgctctccagcgccaaggcgttgtcgctgccccgccggcttgccgccacggcggcggcgatgtcaccggccgaaatcctggagaaggtcgccaagccggcgatcaacgcgattaggacgacgaatcccaccaacaggcgatttgcgatacccaactttgccagcatggctttctccctagtctgccagacgcacttgggcgatcacggccggttgaggtttaaatgtgcgagcaaaatacacctacaaaacccagccagaaccatacaaccaatgcagagcaacttctgactatcgcgctcgctatttgatattaccgatacaaacacgcctataccggcaagcatcaagccaagctcacgatactctttactgatgcgcgtcatcggtgtctttgccggtcatcgccatttatcattaaattattgtcattgtgcagacgcaaaaaactcaagcccatgcgtacagttttgcatacgtaattacaccaactccaaatccgggcgagcaaaagcctcccaggcagtccctgggcaaggactgggcgcatcctgacgaaaaagcgggggatggttggggcggcagcccgccgggcagccgagcggatttgaccttactgacagaccttatagtcgtcggtgacctgattgcggaccgtcttggacaacttggtgaaggcggcgaagccgcgcttctcgatggtctgcagcaactcgtcgatattctcgcagaacccttcggtcagcggaatattgcgggcgaaggtgaccagccgcccatcggcgtagttgatcttgtacttccagtcgtcggggaactcccgctcccaggccttgaggcgtttatccaccgaggagcggaacttggcgccattggccccttcgatcttctgccagcggtcgcgggcgccgggcagcaggcgttcgttgcagcgattggcggcttcgcgcaggaagatcccctggcgcacctcctgctcggccctgatctcggtcgtggaaaagcagttcttcggcttgcccgccgcccaggcgacggcgggacttaaggcgatggcgaggatgattgcggcacggaacatgcggtgggcctggctgtggttgcggcgccattatgccgcagccgcgccaccccccgccagccgagaagcacggccaggatggcggcgtggatggcgggctcggtgatgtccttcttgaccatcatccagtgatgggccacccccaggggggcgatgacatagaccagccggtgcagcgcctgccagcgcctgccgcccaggcggcgcatcatggcgttggtcgaggtcagcgccagggggatcagcagcaccaccgccaccatgcccagggtgatgtagcggcgcttgacgatctcccgtccgatggccgaccagtcgaagaactggtccagccccacataggaactgaaatgcagcaccacataggcgaaggcgaacaggcccagcatgcgccgccagcgggcgacggcattccagccggtcatctgccgcagcggcgtcaccgccagggcgatcagcaggaagcgaagcgcccagtcgcccaggaagcggttggtcgcctcgatgggattggcccccagcccgccggaagcgccccgccagaccaggaggcccagcgggatcaggcagacggcgaacagcaggggcttgacccagccttggcgcagcagcttgtccatcagaaattcgccgccagatccatgccggaatagagcgaggccacctgatcggcatagccgttgaacggcagtgtcttgcgcttcaggaattcgccgatgcgccgctcggctccctggctccagcgcggatggtccacggccggattgacgttggcgtaaaagccgtattcccgcggcgccgccttcatccaggcggtcctggacggcgtctcggcaaagcggatggcgacgatcgacttgatggatttgaacccgtatttccacggcaccaccagccggatgggcgcgccgttctggggcagcaattcctcgccgtacagtcccaccgccagcagggccagcggatgcatggcctcgtcgatcctcaggccctccacatagggccagtcgatgacggagcggcgctggcccggcaggcgctcggggtcctgcagggtggtgaattccacgaacttggccttggagccgggctcgaagcgcttcagcacctcgcccaggggaatgcccacccaggggatcaccatggaccaggcttcgacgcagcgcatgcggtagatgcggtcctccagccggtgcggcttgatcagatcctcgtagcccagggtgccgggcttggcgcattccccggcgatggtgacgctccacggtctggtcttggtgaaatagctgggcgccagttgggcgggatcggacttctccacccccagctcatagaagttgttgtaggtggtgacgtcctttcggggggtgggcggctcgtcggtggagaacggccccttgaccgtgttcagccccgcctcggccggaaggccagacagcgccagggcgcccgccgcccccagcgccaggaagcggcgacgatccagccacagagccttgtcggtcacctcggattcgcgcaagtccgcagcggatctgatcagcatgtccgtctctccacctgccctgaatgtccctcgccgattacatggggattatggcgactttttggaacagatccgtttcaccgcctgccaatcggcatcggagagggcgggcaggcgcggggccggcaaccgccgggcctcgaccgcctcggcgcggcggacggaatcgggatgggtgctgagccaggccagcacctgcccctggcgcccctccatggtggcgaggcggcggaagaacagggccagaccgtccgagccgatgcccgccgcctccagcagggccagcgcccccagatcggcggcgctctcgtcctcgcgggtataggccccggccagggcggcgcccaggccgctggccaccagccccgaggcatcgccggtgatcatggtggcgaacacgccgacgcccagggcgcggatcatggcggcgctcacatgccgctcgccgatatgggtgagttcgtgggccagcaccccggccagttcgtccggcccctcggccttgttgatcaatccggaaaacaggatgatctcgccgcccggcagagccaaggcgttgacgtccttggagtgcagcacatggacgcgcacctcgcgccggtcggcgggcagcggctcggccagccggcgggtcagggcgtcgagcacccgcagcccctccttgccctggcaggccttcatctggccttccaggccgccggcgatggactggccccactggcgctccagcccggcgggcagcagatgggccagcagccgggacaccggcgccagaccgaccatcaacccggccagcaccagcccacccagcaggcagccgagaatcagggccgcatgccggcttttgcgccaggcgggcggcttgggcagggcctcgcggatcaccacggcatcctcgatggccagccgggcgtcgggctcggaggcgcagcgcagcctgatgccgcgcttttccggccactcgccgtcggccaccagatcgtcggtcttccacaccgcgatgagaaagccatcctcgccccggatttccaggccgccggactggacgcggaccatcaccttgcgcgaggcggcgctgcggccgtcgctgaaccgccccgggcgctcggcctcggtggcgatcaaaactcgccggccccgtccagcaccgccaccagcccctccccggtgctcggcccggtatcctcggcccggtggacccgggcgaaatcaggctcgccctcgaccccgatcaccgaacaggcgtagcgaaaggtgcgcagggatgcccaggggcgcaagatcccgaagctgaacagcgagatcagcatgttgcccatcaccagcccgatcagccgccaggcccgggtgtcggccgagaagcggctgccctcgaattcggtccccgccgccagattgcggtaaaagcccgcccggtaccacgccaggggcagggccatggtcaccaccgccaccggcacgagaagcatggcgaagccgattccggccgccgcctggtcctcctcgctctcccccaccagggaagaggcgccggcggcggcggcgatggccgccaccgcgaagatcagcccgctgaaccacaccagggtaaagcggccgtagagacccgaggcggtggcgtcgcaggtgaagcgacggtcgccgaaggtcgtgttgttgaggcggtaggaggccagccacatctcgccccagggcaaggcccagcccaggctgagcggcacggccatccacaccgccaggctgcgcagggcatagccccagcccgatccggtctggccgccccggatgccgcgccacagggtacgcgacatctggtagcgccgcgcccgataaaggcccaccgacaccagcaagatggtcagcaggtaaagccccgacagcagcagcgcccccaggggattgcccgacaccagcagcacctgcgccgaggcgaagccggccaccagcggcaggtagacgatcaccagcacgatcaggaagccgatgaacagctccttgccggtgccggtatattccagcggatcgccccaggcgcgggtggcgctccacaactggcggcgcacattggttttgccccagaagcggtagatggacagggtcaggatggacagcagcatattgctcagcgccgtgctgatcatgtttcccacatcgccggaacacacgaggggacgctgtggagttgtggactgacgcatggctttctcccgaccggatcatggcagggtaaccgccagtccccatcttgtcgatgaggcgcgatgcattcgctgctacactggagggcggcattcccccgccccaaggaggtgaccatgagcgatttccccgccctgatgcttgacgagaccgacggcaaggtcaccgcctccatccgccggctgacggactccgacctgcccgagggcgaggtgctggtcaaggtcgagtacagcaccctgaactacaaggacggcatgatcctgggcggcctgggccggctggtgcgcaaatacccccatgtgccgggcgtggatttcgccgggaccgtcgaagcctccgcctcgcccgaattcaagccgggcgacagggtgatcctcaccggctggcgggtgggcgagacccattggggcggctatgccgccaaggcccgggtcaaggcggactggctggtccccctgccccagggcctctccgcccgtcaggccatggcggtgggcaccgccggcttcaccgccatgctggcggtgatggcgctggaggatcacggcctgcgcacctcggacgagggcgaggtgctggtcaccggcgcggctggcggcctgggcagcgtcgccgtgctgctgctgtccaagctgggctatcgcgtcgccgcctcgacgggccgcgaaagcctgggcgagtatctgcgctcgctgggggccagctccatcgtcgaccgcgccgaagtgggcgcgccgcccgccaagcccctgctttccgagcgttgggccgcggcggtggacagcgtcggcggggccaccctggccaataccgtcgccagtctgcgcgtgcgcggcgccgtggcctcgtgcggcaatgccggcggcgtcgagttcaacctgacggtgctgcccttcctgctgcgcggcgcctgcatcctgggcatcgattcggtgatggcccccaagccccggcggctgatcgcctggaagcgtctggccgagctgctgcccctggaccggctggattcgctgaccaccgaaatccggctggtggatctgcccgagatgggggccaagatcctcaagggcgaggtcaagggacgggtggtggtcgaccctaaccggtgaccacccggcggcggcgcttcaccgccaggatgaacgcgacggccgtcaggttcatgacgaaggcgtagacgatgctgggcaccatcatggccgggttgcccagcagcgtcaccgccacgaagatgcccagcgccccgttctgcagcccgttctccatgaccacggcgatgcggtcggccagatccaggcgtgccgccgcccccagcgcccaggccccggtcatggcggccagattgaggatcagggcggcgggcaccacgtcgcccacatggtcgatcagcgcctgacgctgactgacgaaggcgccgaccacgatcagggcgaacagcaaggtagccaccgggcgggccacgcggcccaggcgcccggccagtcccggccaggaccgctggaggaccagccccaggaccagcggcaccgtatccaccaggaaaatgcccagggtcatcttggccacgggaatctcgaccgaccggtcatagcccgcgaacagggccaggcccacattgaccagcaggggcacggtcagggtggcggccagggaggtgagcgcggtgatggtggcggccagggcgatgcgcccgccggcatgatgggtcagcagggccgaggtcaccccggcgggacaggcggccagcaggatcatgcccacggcgaaatcgggttccggccgccaagccagcaccagggccagccccagggccggcagcagcaccagcttggctcccagccccaccgccagggccttggggctgccgaacaccacgcggaaatcgcgcccatccatggtcaggcccatggcgaacatgatgaaagccagggccagcggcaaggcggcctgggtgatcacagcagaactccgaccccaagcagccccgccagcagcaactggaagcgggcggtcgaggccaggatggcgttgaaggccggaccccgggcctgggtggcaaagcgcaggatcagccacagggcgaagggcaaggcccccaggcacagccagccgcccttcggccccaggggcgaggccaaaagcgcgatgggcgacagcagcagcatgccgtagaccgcctggaggcctcgatgccgacccgaatggccagggtgcggcgcccggccagacggtcgggctccatgtcgcggtaattattggccagcagcaccgccgcggccaccgcccccatggcggcgccgaccatgatcgactgaccggtcaatgacagtgtctgaaggtaatacgtcccccccaccgcgccgatgccgaagaaggcgatgacgaagagctcgccggagggagtataggcgatgggccggggaccgctggaataggcccagccggccagcagcgaggcgaggcccagggcgaccaccggccagccgcccagccaggcgagataaagccccaccagggcggccagggcgaagcagaccagggcggcgcgcttgacccgctcgggggtggcccagcccagcgcggtgacgcgcggcggcccctgacgcaggggctggtcgccgccgcgcagggcatcgcccacatcgttgtagagattggtccccgcctgaatggccagggcgcccagcagcgcggcggccaggggacgcgggtccaactgtccggcatcggcgaaggccagggcgccgcccgccagcaccggggccacggaaatggtcagggtcttgggccggatggccagccaccacagccgccagccgtccggctggtcggcgcggctggcatcggggccggggatgaccagggacggcttttcgggctggccggactccagcttcatgacgcgggcttcacgccggaatgcaggcaggcgatgcccgccgacagattgcgccagacgacgcgctggaatcccgcatccgccatcagaccggccatctcgcgctggtcgggaaagcggcggatggattccaccagataggcataagccgccggttcgcgggcgatccaggcgccgagacgcggaatcacatggaaggaataggcgtcgtagaacggacggatcagcgcccagggcttggagaattccaggcagacgaaccagccgccgggcttgaggacccgaaagatctcggccagggcggcatccgggctggtggcgttgcgaaggccgaaggcgatggtcagggtatccaccgaattggtctcgaacggcatggcctcggccttgccctcgatgaactcgacccccagcccccggcagcgccgctgccccaccgccatcatctcgggcgagggatcgcagaccatcacccggcgcccctgcccggccagcagccgggccacatcgccggtgccgccggccagatcgaccatgacctgccccgcctccggacgggcggccttgaccatttcccgcttccacaggcgatggatgccgaagctcatcacgtcgttcatcaggtcatagcgcggcgccacggcgttgaagaccgcgcggatgcgcgtctcgcgctcctcgggcgtaaccgactggaaaccaaaggtacccgacagcgacgtggtcaagggagatcaccccgacggaacaggaaatagccgatcccggcgcaaagggtgcccagcgccattggataagcaagtgcgaatgtaagatagccgctgcggcccagcgcgtcgaggatgacgtaggagcttggccccagcaccaccatctgcggatcgaacagcaaaatggcggcggtacggaagctttgcagcggattggccacggcaatgccgacaatcagctccagcggcagcctttcgcggatcatcaggcccagcaggatcaggtcgaggaacagcagcagcaccagccaggtgaggaaggccccggtctgggccacgtcgggggtgcgcgccagggtcgagatcagcatgccgatgccgagaaaggcccaggccagggccaccagcaaggcggtgtagaggacgaacaggctccaatccactccgatgccgcgcaccagggcatagagcgccgccactgccatggcgccgaacaccggcaggaacaccaccacgaagcggccgatcatcttgccccagaaccaggcgtaaagggggaccggcagggacagcatgtattcgaacacgccggcatcgcggtcgcccgccaccgaccgcacggtggtgatcaagatgaagaccggcaaaatggcgacgcagagctggatataggtgaccagcaggcgcgacaggccggtaaagcccaggatgcgcgattcggtcaggccgaacacgaacagcagcaccacgatgccgccgaagacgatggagtagaacatgaaccagcgcgaccgcagcgattccgcgatgtccagccgggcggtaaggtaaagcgcgttcatgccgcctctccaggattgtcattccgagcggcagcgaggaatccccgcctggaccggctcggccgattcgggcacagcgtgccaggatgagatccctcggccgcgccgcgccctcgggatgacatgaacagagtcatcagccgtctctcgtcgtggtgttcgcgggggcctcggagggctcgcagcggctggtcgagcccttggccagcaccgcgttcttcatggcggcatagtccatggcgcccgcctgccccgccgccacggcgccaaagccgtgggccatggggctgtgctggccgtccacgtaaagggccttgcgcccgtccatccactggccggtctccaggccgccgacccagaattccaccgacgcgtcatcggcccagttctgcttggccatccacagcacggcatcgcccagatcgtcgaacttgtggatcttgcggtcggcaccccgcacctgggcggcgaaatggggatcgtcaatgatcatgccgcaatactcgcaggtctcgcggccccacttgatctcggccgggccggtgctggactggccgcaggccgacacggcgatcaccatgcccggaaccagagccaggaagcggcggcgattgagaccatgatgctcgcacatgatgtccgctcctatttcatctcgatgccggccaccagaccggcatagcgggcgagaacgcccaggaagcgcaggcggtcgggcccgttgaccacgccgctccaggccgtgccggcggggtcggcggtgaaccgccagtcgcccatggccttggcgaaggccggctccgcccgggtcaggcgcaccacgcagtcgagccgcgccgtcatctccacgtcgtcggcgacgcgatcgtccagcgccaccttgccctgatccatctccaccacccggttgaccagggcggccacctcgtcgagacggtggctggtgatcagcatcaccgccttctccttccgctcgttgagcagctggaagaagatgtgccgcgcctccgggtccagattggcggcgggctcgtccatgatcagcaggtcggaatcgcggcccagcgcgatgccgatcagcatcttctgcttcatgccgcccgacagcttcacgaagggccgcccgcgcaccatgtcccagtccagccccagctcgcgcaccatggtgatgatgcgctcggggtcggaaccgcagacggcggcggagaaattgaccagctcgcccaccggcatcttgagcggcggcggtatctggggcacgaagcccacatgggacagcacggtcttgcggttgccgcgcggggccaggccgttcaccgtgaccgcgccctcgtgcagatactcgcccagcaggcaacggatcagagtggtcttgcccgcgccgttggaccccaccagcgccacccgctcgcccttgtcgatggacaggctgaccccgtccagcaccctgtgccgcttgaaggtcttggagacgttttcaaaaacgatcattcggttcctgccctcacctgtcccaaccagcctacaacagcttgttcagtcccttgacctcgtatttcagcgatcccgtcggacaggcgtcgatgcacaggccgcagcgggtgcaatcggcgccgatggccaccttgacgtcgtcggcataggtcttcttggtgcattccagcacatggggcaccagacagaccttgcggcaatcgccctcgtgcaggcagttctccatgctgtagctgacccgtagcggcgacaccgcgccgacgaaaccataggtcaggccgatggggcagatgtagcggcaccacatgcggcggatgaagatgatctcgtaggccagcagacccagcacccagaccatggccaggcccggcccgtagatcagggcgcggctgacgatgccggtgggcgagatggattcgaacaccgtatagccgctgacgaaggccaggacggcgaaaaccacatacagcacggtgcgcgagccgcgatgcagcgggtaatccaccaccatcttgcgcttggcgagcgccagatgaatcttctcggcgatctcggccagcagatggtaggggcaggtccacgagcagaaggtgcgcccgcccagcagccaccacatgaacagcaccgtgccggtgccgatcaccagattgatcaggatgaccttgtaggccagcatcacctggatggccgaattgaggtcggcgaagtgaaagccgatgacgcgggacgcggtcagtgcgccttcgaccagttgcacgtcgaaacggaacgacagcacaaagatcatgttgaccatgatcagcgtcgcccagcggatgttgcgccacttgtgcgaatgcttttcggcgtgggcggccttgatctggcgggccttctccggtcccttgaccagacgcttggcatccatcatggcctgggcttcgggggtgtagccggtggggcgctcgggcgcggcgcccagcatgaccttgagcgaggagaggagcttcatcacgcgtctccccacttgcgccggatgtcgacgacgatggaggcgggctcggtcgggcagatcatctcgcacatgccgcagccgacgcagggctggtgcaccaccggcgtgcggcgcttgtcggccggatcagcgctcatgggctcgagagtgatggcgccctggaccgggcattcccggacgcacaggtcgcagaccgccagatcgtatttgtactcggccagcttgaccggcttccagcggtcgatctcgggatagcgatggacgcccttgaacggggccgggcgggccacgcccttgaacccctcgcccttgcgcgccaggcaggcgttggggcggtccaggcgggcgaggcccatgcggacctcttccttcttgctgatcttgtggctgagcgccccggtcgggcaggccagcacacattgcaccgcatcgcacgagaagtcgcaggcctgggcccgcgccggaacgtaaggcacgccgacgccgaagccctcgtccagatcacccagctcgatggccttcaccgggcagacctgcacgcactggccgcacttgatgcaggccgccaggaaatcggcttcgtcgatggcgcccggcggccgcagccggggcgtccacttgcgcagcaccggaaagaacccgaacagcgaggcgccgaccacggcgccgcccatggcgatggaacgcatcaccatgcgccgcgtcttgttgttggggtggggagtcggcgccaccttgggcggcgcatcgtgctcagtcatcatccttgctcccaaaagtgccgcgccggggctcgagcgagccgccgcggccggcgcccgccttttcgtgggcgacggggacttcgcccgcccgccgggggcggtcgatattgcggttgagatcttccgtggcatcaagactggagccagccttcacccgggcgtcggaggccaccaggggatgcttgtcctccagcatcagcactggctcggagaacggcgccagacgatcgaggaagtccagcacctccagcagcggcgtgcccttgaaaaagcgggtgttgggcttgtccatccacacccgtccggcgtaattgaacagccggtggggcttgtcgcccaccccgtcgccgtcgcggtcgaagccctggtaatcttcccagcggttgccgtcccagacattgcgcttggcgctgccgccgccatagaccgccacttcggtgatgttgccggaaaacagattgccggtgaactcgttgtccttccagtcgttgaggaaggccacaccgatgtcgttataggcgatgcggttgccgcgcagatgattcttgctgtcgggctcgtagggtgccacatcgatggaaatgccttgcgagcaatagagaatgtcgttgttctcgatcaccacgtcgctgctttccttcagcgagatgcacaccccctgggccccaaccgccttggcgatgacgttgttccgcagttcgtcgccggtgtcgtacatcatggaaatgccggtggaattgtcgaagaagtaattgccctcggcgatgttgtactgggcctgcatcagatgcaggccatagcgcccgccgctctgccggttgccggcgaagcggttgtgggtcgagtaccagaagacgatgtcgcgcccctggatgaactggttgtcctcgatcacgttgtgatgcgagtaccatagcttgatgccgtcgccgcgccgtcccaggctgaccttcttgccctcgacccggttgcgccggacggtgttgcgctcggactgctccaggctgaagccgaacagcacgttgtccatgcggaggtcttcgaccacgttgtccttgccgcgcacctgcacacccgcatcctgcttggaatggtcggggccggtattggtgatacggaagttgcgcaccgtggcgccgtcggtcttgatccacagcaccgagccccgcccctcgccgtccagggtcacctggttcttgccgtcgaagatgatgggcttgctgaccaccagatgggatttgtagcggcccggcggcggagaaatcacctggcccggctgggcgatgtcgatcagcgcctgaatcagcgaggaatccagcagcggctcgttgtcctgcccctcgggcgtcgcccccgccgtggacaggctggcggcgaagacgaaggccatggctcccagtctagacttggaaaaggtcttgatgagcacacccatggtccttcgtctccgctctccagcgcgtgagaggctatttggacttcagcgccttgcgctgcaacagcgtcgccagcaccaggcaaagggacgccgccatcagcaggccgaagccgtagtgagggtaggagtaggtagagaactgcgccaccttgccgtcgccgaacaccgtcggcatgaacggcttgaccgaaaaggccgcccaggcgcgcagattatgcccgaaccaccacagccaggcggaatagtcgacgacgaaggccaccggaatgacgatgcccgagaagggcagaacccaccagaacggcccggcatagaacaggaaggccaccaacatcaccgccaccagggagaacaggtaaggagcggccttgatctcgtatttggcgccgacctcgatgggctccatgccgatgaagtggttgatcacgttcatctcgtggacgcaatccaggccgccttcctcgtcgccccaggcggcttccttgccgtccttgggcttttcctggctggcgcagccgttgaacacgccgttgacgtggaaatggatgcggataccgtcagggaaggtctcggccggatagttgggagccttcagcgccacccaccagatgggtgagaaatacgcaccgccgatgaaaatcatggcgatcacggtaaggattcgcacgagcgccggcttgctcttgctgttattggccatggacgttaccccgttggctggtcaggtggatcagagggaggaagggcggcggccggaaagcccggacaccgcccagtatccaccttatatcagaaaaatctactggaagtcaggatttttccagcccttgggggcaaccaaatttgccgggggcttcaggcgcgaggtgtagtccagaaccgccttggtatcgcgatcggtgaagctctgaatctgcttcatcatgtcgggattggcgttgcggcgcttgccttccttgatccactggtactggcgcagcaggtactcgtaatgctgcccctggatgcggggatagaacttgtcgttgtcgccggcgccgtcggcgccgtggcagcgggtgcagttctcttcgtacagcttcttgccgtgggccagatccttgccgtcgcccacgccgggctcggggttcatcttcagcttgaccgccatataggcggccacgtcggcgatggcctgcgggccaccgatctgcgacggcagggcgaaggggtacatggtggggttatcgcggttgagcgcacggatgtcggccagttgcttgatcaccaccttggggtgctgacccgccagctgcgggaaggtgccgtcggtcaggccccagccttccatctgatggcaggcggagcacacttcgtagacttccttgccattcgccaggtcgggcttgaggtgcagggcctcgtcttcctcgccgccgccggcatgccactgatagccttcctcgcccagggacttgcccttctggggggtcccgccgccggcggcgatggcggcgccaccgaccaggagggcggaaacagcggccagggcggccaggctgtgcttgaacttcaacatcgctctatctccacgttccaacgaactgggcgtacattagccgaaccggggttcgccttacttgactgtggacaagtaatcggcaatctggccgatctcgtcgtcattgaccagatgcatgaccggctgcatggcgttcgccttgccgttggcccgcaccccggccttgatgtccttggtctgggccagaatataggccttgtcctgaccgccgatggcggggtagccgggcagcggcttcttgccttccttgccgtggcaggccacgcaggtcttggtcatgaacagggtcttgccgggatggggcgcgccggcggcggccgcggcggcggcgggcgcctccttcaggctgaacagatactcggcgatggcctgcacgtcggcatcggccaggtcttccacgatgggcttcatggtgtcgacggtctggccgttcttgcgggcgccggacttgatgtccttgatctgattggtgatgtattcgacgctctgccccgccagcttggggaagccttcctgcagcggagtcttggcatcctcgccatggcaggcggcacagcccttgtcggcataaagcgccttgccatcggcggcgagagccgggccgaaggagaccgcgccgaaggccgcggccagggccatgacgggaagctgccgcttgatggtcttgaacatgtctgatcctctccaggctcgggaagaccgagagcaaggtcaggccagccctcgtgtccggataatttcgacggaaactacccctggggtgcgggcacccacatgactttggttaagtcttggatttttccggggtccaggctgatgccggtcggggagctgatgccggtcaggctggggaattcaaaaaaaaacggcggagcgggcaagcccaccccgccgggtctttggagcgaaccggggcgggagcgatcccaccccgatccaaccgggtccggttttacttggccggagcggcttccaccttcttggcgccgttctgctccaggaaggtcttggcacgcaggccgatatcggcggccttgacctggtactggaaccactgctcggcccacaggaaggcgctgttgtagtcgcccttggcggcgaactcttcagacttcttcttgttctgctcggcatagcccagctgctcggtggcgtcctcgaccatggcgaccacggccgggaagtccttgaagttcacgctggtgatgtagcccacgacgctgttgatgacgccctgggtttccacgttcgccttcacgcgggcatcgtagtccttctggccgtagatctggccttccttgcccttggcacccgtggccttgtagttggcgggctgaaccagcaggtagccttccatctcaaggtgcagcgccgagcagaactcggtgcagtagtacgggtacacgccggccttgttggctttgacggtcagcgaggcggtcttgcccggctcgatggacaggttgccgttgtgcttggagatggcgaaaccatgggtctcgtcctgggcacgctcgaggttggtcaggtggacggtgatttcgtcaccctcgttcgcctcgatgatttccggcgtgatgtgcgagcggatcacggtgccgaacacttcgaccttgcccggcttcttctcgatgcgctcctggccggggcgaaccgcgaagggcgacttcttctcggtgcgagaatcggtgccgaagggatagcggacgttggtcttcagcttctccaccgcgatggagacggcgtagtggggctcgcccagaggcagcggcatatcgtacagcagctgcatcttgtcgccggagatgtcgatcagctggtggttctgcgggtgcagcgggcccaccggagcgaagcgatcgatggccagcttgttcagggcgatcaggtacttgcccttaggcttggcggtgtcgccttccatggccatcagatggccgatgttgtagtgcaccgacagcttgtcgatgaccttgccttcacaatagtcccacttggcgaccatggaatccacgtacagcgaggtatacgcgatacagggcttcgagtcgtactgggtgtgcagcgggccgaggcccagggccacctgctggtgggcgacggtttccagggcgatgatcggaatgccgtactcgtccttgcccgcgaagttcttggcggcgacggccgcttcgatcttggcgatgtcatagacggtggtgtggctgtccagcttgcccgaaacggtcacatacttgccgtccggagtgacgtcggcgccgtgggggctcttgggctcgggaacgagcaccaggatgccttccttgacggcggtgtcgatggacagcacgttgtggccgttgatcttcttggccttgccggccttgaccagctcggcggccttcttccagttgatcacgtgcagatagtcgtgatccttggccgagcagcccgcttcgaagggcgggcggccgcgctcgatgccgccgacataacgctcggtgcagaaggagttgatgaacgaccagccgtccgacggacccttgccgaagtcggacagatcctggctgtagggcggcagctcgaccgagaacgagttctcgggctcgatgcggccctcggcgcggttgaacttccaataggtcacggcgccgcgatacttctcgttgaactgctccagcggagcgaattcaccacccaggggggcggggtactgggccggctccatcaggtagtcggtgttcgggctgacgaaggcgccgccatgctcggactgcagaatcggattctggacgatctgcttggtctcgaagtcgcgcaggtcgaccacggcgatgcggggcgtgttcttgtcgttgatgaacagccactgaccgtcggactcgccgttggtctcggacagcgccgggtggtgggtgtcgccccacagaacctggcggccctgaacttcggagccctgcttcagcacggccttggactcgtcgtcatagccgtagccctgccagggctcgggagtgaagacgccgatatacttgaggatgcgcatggagggcacgccgtacacgatcacctgaccgctctggccgcccgagctgaacaccatgaattcgtcgagcttgccggtcggattgtaggtcttcgccgcggcaagcatgtcattttcggtcagaccgcgacgcttcatgacgtcctgcagcgattccgccgaagcggtaccggccaccagggcgccaaagctgacggtcgcgagcagagtcgccaatttgaggcttctcgtcatcttccccaccttttgaattgttgaaaccaaaatgagctttacccaaccttcgccgaagacgatgggaccggggcgactcgaaagccttaactttcgtcaagaaagaccctttaaattccacgcgccgagggcatgccggccgggctatgatcgcgcttccaaaatggcgcgataagcggcatccaggtgcggactttggataaggaatggacggccatgcggcggctcttgctgatacttctcatctgtctgacgacggctccggccgccctggcccagccagtcgaggaccgcccgatttccgggcgtttcctcctcaccgacatgaacgggcgggcggtcagcgacgagagctaccggggcaagatccgggtggtcaccttcggctacaccttctgtcccgacatctgcccgaccatcctcaacaccttgtcggtggcgctggagcagctgggggccgaccgggccaaggtggcgaccctgttcatctcggtggaccccgagcgcgacacgccggcccatctcaaggaatacctcaacgccttccccgagatcaccggcctgtcgggaacgcccgagcaggtggccgccgccgcccgcaacttcaaggtccgctacgagcgccagcagcccgacggcagcgacccctcggtctatgccgtggatcacagcgcctccatctacatcatggatcgcgagggcaatttcctcgcccgcatgccgcatctgtcggcgccggatcgggtggccgagcgggtgcggtcctacctggccccctccagggtggagcgctgaccatgaagcgccgcgccttcatcctgtcggccgccgcgctggccgccatgcgcaccctgcccgcccgggccgcctccaagagcctgcgcggcctggtcattcacgaccggccccagcccgttccggccatagaaatccgcgacgccgagtcccggcccgccgggctcgacaccctcaagggcaagccgatcctgctgaatctgtgggccagctggtgcatgccctgcgtggccgaactgccggcgctggaccggctgaagcccgccctcggcgccaagggcgtcgccctggtggcgctgtcgctggatcgcggcggcaaggtggcggtgaccaacaccttcgcccgcctcggcatcaagaacctggacatccgcacggacgagaaccgtgtggcggcggaaaagctcgacgcccccgccctgccggtcaccctgttgatcgacgccgaggggcgcgaggtcgcccgcttcatcggcgccgccgaatgggacggcccccaggccgcccggctgatggacgccctggcggcgggaagccgcctcacccccgacatggcgccgcccccggtcaggctgggaacggcgccgtaaggctggcccggcgggctgccgccccgcttggccctatttgtggccgtggtgcatcataccgcccggcatgccgccacccggggccattccgccgggagccattccacccggggccatggcgccgggggtcatggccccgggggccaggaccggcacctgcacggcaaccttgcccgccttctcgaagaccagggtgaccggcacggtgcggccttccttcacggcggcgttgaggccgatgaacatcacgtgatcgccgcccggcttcagctcgacggtgccatgctcggccacggccagggattccaccttgcgcatgcggtagatgtccccgtccttgacgtgagtgtgcaactcgaccgccttggaaatatcggattccgccgccaccagacggtcggcgccgccgtgattgttgatggtcatgaaggcgaccccggtcccgccggccatgggcgcggcgcgcatgaacgggttgaccacctcgatatcggcggcggcggcctcgccggcggcggcgagacccagcagcagggcggcggcaatggcagtgaacttcatgagcgaaaactccggacgacacacgaacgaccccaccccactggttgggggaggctggctgaagacacaatatcgggataacgcgggaaaggcgacgtcaggccgcctggatcggaggcccgcgggcgaaatggtggtgggatgcctgcccgtccacgtgtgacgaagcggtcgcggcgatgcgaagccctgccgtacctgcggtgggtactttgaaggttggggacggcaatgcccctttcgcctgcgacgcggcctgacacaccaggcagcatccgtgactgtccgactgcccctcgtcgcccatgggggatggaaccgccgtacgctcggctccgcccaggtttgacgcgtggcagattccggtccgcgccgccagcgtcaccaggagggttccccccctgaacgccagatcgagaccgggaagcagaccctggaagaggaatcccgccgccaccagcgccacggccaccagccgcgccacaaggcgacggtcgacggcggagctggactgaacggcgcgggcagagcgcaaggcgatcctcctagggcgttgcactaggaatgcacgccggcgaaagcccgacattgacccaggtcaagtccagaaaatatcagagccgggcacccgccgccgcacggcggccgttgaccgccaggccgtgggcggcgtgggcggcatgggcgcgggcatagggggccagcttggcatcctcgcccaggatatggaccatgacccacttgtccatcaggctgcggaccgccagcacgaaatcatcgtgggggctgccgcccatcagcggtgacagcaacacccgccgcaggccggacgccatttcggcatgcagcgccatgtgccggacccggtcgggatagccgcactggagcatgaacatttcctcgcgggcgaaatgctcgccagcctcggccatcagcaccgccgccgccgccttggcggcctccagtgtccggctgccttccagttcacgccaggccgcgatcatgcgatcatggtcgtcgtcgaggggcttgtgcccgatagtgtagctggtggccatgtcacccccacaaggacaggacagtacacatcaatactccctcatgaggactgaacgaacaaacgccagtctgtaacgctttcctgtgattttatgacaccttcaagtcaaacatatccaaaggtaatagcaaatgcttccctactccttcttctccgccatgctccgcttcgtcgccgccaaaacggaggccgccgcgacggatgcacggacggcggagatggccgcggtattgcggcgcattgccgacacggtggaccaggggccggaattcgaggtgcccggagacggcctggaattgaatgcccgggcgctggccggcttcgccgccttcctgcagcggagcatcctccccgaggcggtggcccacggcaatcaggcgggggagaaccaaatccgctggtcggtggatgccgccatggacgcggtcaacaccttgctgtcgcgcgcggcgctgcaggaggggcaggagaggcaggcggtacgcatcaccctccccgctccgccgccatgacggcggccacccggtccttgcccgggaccacccgggcatggttcactaaccctgggtttatgaaacggttcggggagtgggcacaggcatgctgaccagggatgtggcggcgggagaggtgatctttcgccagggtgaagccgccgaagtggcatatctgatcgaggccggcaccatccggattcagcaggagatcggcggcgagacccgccctctggcgcgattgggaccgggcgaggtctttggggaattgggggtcatcgacggcgcgccccgttccgccaccgccttggcagaaacgccggcgcgcctggtcatggtgcgcggcgacaagatccagcaatccatcgcccgctcggaccccttcttcgccgagctgatgcgcaagctggtcggccggctgcgccagtcgcgggccgccgacgattccgacgtcatggcggcgctgcaaagctcggatttcggccccggctacgaagaaatcctgcgggaacgcgatatcgccgaaggcatcatccggggtgagatcgagccgtttctccagcccatcgtcgacctgaggaccggagccatcaagggctacgagaccctggcgcgctggcggtcggagaaattcggcctgatgacgccctgcgcctttctgccgctggcccggcgcaccggcctgatccggcgcatcgacctgaccatggccgaccgggcgctgaacatctgcgccggcttcggcaccggcgagaacgcgcctttcgtggccatcaacgtctcggcctggcacctgcgcgaccgcaccctggtcgacaccttgaagcgcatgctggaacagcatggcctgccaccccgtcgcatatgcgtcgagatcaccgagaccatgctgatcgacgagacctcggacgccgattccatgctggccgagttgcgcgattgcggcatccgggtggctctggacgatttcggcaccggcttttccccgctggccttcctttaccgcctgcccatcgacatcctgaagatcgacggcagcctggtggagggcatcgaggcctcgccccgtcagagggatgttctcgaaggaatgcgggaactgtgcgcacgcctgggcatcgatgtcatcgtcgagggcatcgagaccgaggacaccacccgcattctgctggaattgggcttcacgctgggccagggaacccgctttgccgctcccggcgcggtggacgagaccttgaagcggagggtgtcatgagcgacatgacggccaatgctaccctctcgcaggcccacgtggagaccgaaaaggtcttcgccagcctggccgcctaccagcacgccctggccagccacgtggactggctgcaatcctggtacagctccgtcctcaactggcacgaccggacccaccccaccccgcccgccgaccagtgccggttcaccgcctggttcgacgcggcgggacaatcggccctggccgtctacccggccttcgccgaattgggacagttgcaccacgagattcatttcaaggccgaccagatcaccgaacgcgccgccgaaggccacaccatcaccacctcggattacgaggcgatgatgagcctggtcctggccttcagcaccgccgcccagggattggagcgggacgcctggcgcaccctggccaccgtggacgccctgaccggcctgggcaaccgtcagaccatgatgagccacctgatcggcgagcgcgatcgcgccatgcgccaaaagcagccatgctgcgtcgcgctggtcgacatcgacctgttcaagaaggtcaacgacaccttcggccataccgagggagaccgggtgctccgcgccgtggccgagagcctgcgccgcaacgtgcggccctatgacgtgctctaccgctatggcggagaggagttcctgatctgcctgccggccgccacccccgaggcggggcggcaggtgctggagcgcatgcggtcggccatcgccgccctcggcatcaccagcgccacgggcaagcccatccccatcaccgccacgttcggactggcggaattgtcggccgatctgtctgtggaggaatccctcgaccgcgccgataccgcgctttacgacggcaagcgcgccggacggaaccgggtcgccgtctggagctgacgctccccggccccagaaggcaattggacgcacccaaaccattgatgtagcattcatctaccataaggctgagagggcgcagacgcgggtcgcatcctccgttctgaatcaggggggacgtcatggccggcttgttcaaggtggatgtagcggccggcatggcctgggtcgaaatccccgagcgggatttgcgggtgctgtgcggctgtcccgccgacgcggtcaagcacatgatgctgcgcgggctgatccggccgacacggcgggacggcatcccgtgcgaaaccggacccagcgccattctgctctccgacgtgatgatccagaacggcgcattctgcaatctggcggaatttccggtcctgcagatgttctatcgccagggcatgctgctgccggggcaccccaacaataccggtcgccggccgctgctgatcgggcggaacgagcagcttcaggcccagttccagtacatctatcgcggcaattacggtctgatctccaccgaggaactgatggaagccggcctggacgaggccacggcccgcgacatgatgcgcctcaagctgcgcttcgccttcggccgcatccagcacccgcgggagctgctcgacacccggcccctggccgacgagcccatcgagatcgccgaaggcgtcaccctgcgccgcaccgcgctcaacgtcttcgagttcagccatggggacgaacgggtcagcgtcgacctcaacctgccgcccttcgagattcacgaatgcccctataccctgggctttcaccagatcccgcgcgagtatttcgccgtcattcactccggcgacggcgacggctgggacatccggcgccccagcatgggcgccatcctggtattccaggggcgcatctacctgatcgatgccggccccaacctgatctattcgctgaacgccctgggcatcggcatcaacgagatcgagggaatcttccacacccattcccatgacgatcatttcgcgggactgaccacgctgatccgcgccgatcgccgcatcaagtaccacgccacccccatggtgcgggccgcggtcaccaagaagctggccgccctgctgtccatcgaggaagaggacttttccgactatttcgacgtctgcgacctgacgctgggcgagtggaacgacgtgggcgggctggaagtgcgccccatcttctcgccccatccggtggagaccacgcccttctacttccgcgtcatggcggaggggggctaccgcacctatgcccacatggccgatatctcggggctggacgtccttcaggggatgatcaccgaggacccggccaagcccggcctgtccctggcctggatggaacgcatcgtgacggactatttcgagcccgccgacgtcaagaaggtggatatcggcggcggactgatccacggaatggccggcgacttcgccgaggaccagtcgcgcaagatcatcttgtcccacaccgcgctcaagctgaccgacgagcaaaagcgcatcggctcgggcgcgtccttcggcaccgtggatgtgctggtgcgcagctaccgcgacttcgcccggcgttcggcctacgagcatctggccagctacttccccgagatcggcgacgcccacctccaggtcctgctgaactgcccgctggaaagcttcaacccggaaaccatcctgatccgcgaaggcgccatcggcgacgccatctacctggtgctcaccggccaagtggaaatgctgtcctcggacagtcaggttcgctcgttgctgtcggccggcgccttgctgggcgaactggcgggcctgcacggcctgccctccatggagacctaccgcgccacctcctatgtccaggcgctccggctatccgccgatttctacctggaattcgtcaagcgccacgacctgttcgccgatatttcccggctgatggaaatccgggaattcctcagccggacctggctgttcggcgaagtggtgtccaccggcacgttgaaccgcatcgccaatcacatgcgccccttggccgtccacgcgggcgaggccctgtcggtgggagagagcaacgtggccctgatccggttgggcgacgccatccggctactgggcgagcaggaactggaacggcttggaccgggcgatttcttcggggaagaaaccgccatgttccagacaccgcgcctgtcgcgcatcatctcgtcggaaaccatggagctttacgtggtgccggcccagacgctggccgacatccccggggtgcgctggaagctgttcgagaccttccaccgccgcacccgcgcctgcgccgaggcccaggtggtgtccagcaccgatctggtctggcgcgacgaatactcggtcaatatccagcgcatcgacaatcaccaccgccggctgttcgagatgtccaaccggctgatcgaggcggtgcgcctgagcaagggcaaggccgagatcggcgaggccctggacttcctcatgggctacgccatgtaccacttctccgaggaggaagcgctgctcgagcgctatggctaccccgaaggggccggacacgcctcccggcaccggcgcctgatggcccaggcgcgcgaattggaggagcacctggcgtcggccgccatctccgccgacgaggtcttgaccttcctgcaggactggatcgtcaaccacattttgatggaagaccgacgctatgcccccttcattaattccaagggagtgtactagggtaaaggcccgaggcaacggtcgcccaacaacaacggtaattctccgggaggcaatggaatgacgggtgacagccgaaaaggcgcgccgtctggacaagacatcgacatgaccgtgatgcagggggtccttgaccacctggaccagggcatatcggtcttttccgccgatctgcggctgattctatggaaccggcgcttcaccgacctgcacgattttcccgaaggcttccttacccacggcctcggctttgccgacatcatccgcttcaacgcccaaaggggtgaatacggcagcgattgcgacgtggaggccaccgtccgccatcgggtggacgccgccatggagttccaggctcaccgcttcgagcggacgcggcccaacggcaccatcctggaaatcatcggcaaccccctgccgggcggcggcttcgtcaccacctattccgatgtcacggtcaaccgccaggtggcggaaaacctgcgggattccaatgatcgcctcgaccagatggtggaacgccgcacccaggcgctgcaagacagcgaggagcgccaccgcgcctatggcgaatttctcgaagccaccgtcaagcacatgccgcagggcgtctgcctgttcgacaacgatctgaatctggtagtcgccaataagatctttttcgacctgacccagattccggccagcttcaacgtcaagggcatcaacttccacgaattcatgctctacaacgcccagcgtggcgagtacggccccggagacccggcggagctggccaaccggcggctggagatcgcccgcaggatggagccccacgccttcgaccgcatccgtcccgacggcacggtcatcgaagtgcggggaaaccccatccccggacgcggcttcatcagcaccttcaccgacatcaccgcgcgggccaaggccgaggaatccctgcgcgaagccgccaccatggcccgggccatgctggatgcccccgggcttctggttctgctcatccgcatggacggcaccatcgtcgacctgaaccaggaggcggcgaccggcctgagctccaccaaggacgccatgatcggcgccaatatcttcacggtcatgccgcccaaggtggccgagcggcgtttcgcctacgcccagcaggcggtgttcgagggccatgccgtctatttcgaggacgagcgcgacggccgctggttcgaaaccaccatgaccccctaccccatggatcaggacggcgtccaccgggtgatgatcatcgcccacgacgtgacgcaccgccatcacgccgagcagcgcctgcgcgaggccaccgccatggcccaggcggccaaccgtaccaagaccgatttcctggcggccatgagccacgaattgcgcacgccgctcaatgccatcctgggattctccgagatcatcgcgcgtgagatgttcggcccggtgggcgaccgctaccggatctacggccaggacatcaattccgccgggcaacacctcctggccatgatcaacgacattctggacatctcgcgcatcgagattggcgccttcaccctatgcgtcgagcaggtcaatccccatgaactggtggattcctgcctgcgcctggtcaccacccgcgccgaggccgccggcatccgtctgcgcgaggacctgcccgagaccctgccctccctgatgatcgattcccggcgcaccaagcaaatcctgatcaacctgctgggcaatgccgtaaagttcacgcccgccggcggcagcgtgaccctgcgcggcgcgcttcaatccgatggcggcatggccttccacgtggccgataccggcatcggcatgagcgaggcggatatcgccatcgcgctgtcgcctttcggtcaggtggatacgggactggatcgccggttcgaaggcgccggcctgggcctgcccctggccaagtccctggccgagctgcatggcggcagcctggagatcatttccacgccgggcgaaggcaccacggtcagcgtctatttccccgcggcgtgcgtcgcgaggtagggttatgtccgcccctcgccgggcgcggccttccggccgcttggccgccgcctcaatggcggctgatcgcggcgtgcgccaggtttggcgcccaccgcttgagcggcagcagccccgccgcgcggcaccaactgatgattccccggcccgatcaggtcggcgcggcccatcttctgcagcgcctcgcgcaggatcggccagttctcgggatcgtgccagcgcaggaaggccttgtgcaggcgccgctggcgcaggcccttggcggtgaacacctcctcgcccacgcggcgcaccggccggatggggtcgcggccgctgtgatacatggcggtggccagcgacatgggggtcggcaggaaggtctgcacctgatcgagcctgaagccgttcttcttcagccacagggccaggttcagcatgtcctggtcgctggtgccgggatgggcggcgatgaaataggggatgaggtagagcttcttgcccgccttgaccgccgccttctcgaacatgtccttgaagcgctcgtaggagccgatgcccggcttcatcatcttggacagcggcccgtcttcggtatgctcgggggcgatcttgagatagccgcccacatggtggcgcaccagttcgtccacataggccggactggtcaccgccagatcgtagcgcacgcccgagccgatattgacccgcttgacgcccttgacgccccttgctgcgcggtaaagacggatcagcggatcatggtcggtgcccagcgtcttgcagatgtcgggatagacgcaggacaggcggcggcagaccttctgcacctcgggctcgcggcagcccagccgccacatattggcggtcggcccgcccagatccgagatggtgccggtaaagcccttggtcttgtcccggatctcctcgatctcgtggatgatggaatcggccgagcggctctggataatgcggccctcgtgctcggtgatggagcagaaggaacagccgccgaaacagccgcgcacgatgttgatggaaaagcggatcatctcccaggcggggatcttggcctcgccataggagggatgcggcccccttgcatagggcaggtcgtagaccccgtccagttcgggagtggagagcggaatgggcggctcggtcacccacagttccctgtcgccgtggcgctgaaccagcggccgggcgttgagggggttgctctcctggtgcagcactcgcgacgcctgggcgtacagcaccggatcgtcctgcacttgctcgaaggaaggcaggcgcaccaccaccttgtcgcccttcagggccggcggagcggtctccaggtccgaggcatccaccacccgccagtcctcgggcaccccgggacgcacgaagaccgtgccccggatgtcgtgcatctccctgggcgcctcgcccgccgcgctccgccgggcgatgtcgacgatggcccgctcggcgttgccgaacaccagcagatcggccttggcatccaacagcaccgaacggcgcagcttttccgaccagatgtcgaaatgggcgatgcggcgcaaggacgcctcgatgccgcccagcaccacgggaacgtccttgaaggcctcgcggcagcgctgggcatagacgatgacggcgcggtcggggcgcttgccgccctcgccgcccggcgtatagctgtcgtcgctgcgcaggcggcggtccgaggtatagcggttgaccatggaatccatgttgcccgccgtcaccccgaagaataggcgcggacggcccagggcgcggaagggctcgggcccgctccagtcgggttgggcgatgatgcccaccttgaagccctgggattccagcagccggccgacgatggccatgccgaagctgggatggtccacataggcgtcgccggtgaccagcaccacgtcgcactggtcccagccgagcgtctccatctcggcccggctcatgggcaggaagggcgccgcgccacggcggggaaaggaaaggggctgaactggtgtcatgatcaggaaatcaaatgccgtcgccgtctcggtatcccctgtcatcctcccctttgccattcagatgcaacacccatttcgccagcacgcggcgcgccgccacgctggaggcggcgacgaacacgccgacggtgaggagcagaagggccagttcccgccaccattccaccagggccagatcctcggacagcccgaccgagaccaggagggaatagccgtcgatggcgcggaaggcgccgatttccggcgattcatcggtgggatcgggaatgcgcccgaccagttcccgccgttcggcgtcccagcggcggaacagccggctgtcccagaaagtccgcccggccagggaatagtcgcggggatggttgaccagcaggcggcccgactcgtcgaagatgcgcaccccggcccccggcatgagctcgagggcggcgatctgcgaaaaaatgtgctcggtgtcgaactgcagcagcagcatccccatgaagcggccgtccagatcctgcagccggcggctcatcatcagccgccagcgggtcggccccgtctcccccagggtcaccgaggcatcgccgacgaagacggcgctttccaatccctggtcgcggtgcttctggaagaagaagccgttcgccaggctggggccgggccgcgacagcggcaccgacgccgccacgccgcgccccgaggcatcgaacaccagcaccgccgccacctggggcaggcgctgggtggtcagctggaagacccgctgcaattgcggcaaggaggcctgggtggtgacgaagcgcgtcgccaccggccgcagatggtcggtgatgtgaatgtccaccggccccagcgtggtggtcagggtccgggaaacgtcgcgggccagaacctggacctgatgctgggcctcctcgtaggcccggtcgtgctcgatccacaggctggcgaagtcccaggcgttgaacagcagggccaccagggcgggcggcgccagcagcagcggcagccaccgccgcacccagccctttagcgtccgtctgacccgcgtcaccattgccgccctcgtcaaaatgctgcaatgcagcatagacggtagcgcgttttgcgcttcaagccaatgactcttgctatgggcaggccgaggaggcacattccccccttgttttcgctccagcggataagccgggaaaagatgatcaggatactggcggttcgacttgttgactggtgctggcgccatgcctggaccgtggtggtcgcctcactggccgccaccgtgctgctgggctggttcgccgccacccatctgtcgctggacaccgacgaaagcaagctgatctcccaggatctgccgttccgcaaggtggagcgcagcatcgaccaggcctttcccagcacctccgaacggctggcggtgatcatcgacggccccaccgccgaactggcggaagaggcggtcgagcgcctcgcccgggtgctgcccgccgcccataaggggctggtccacgacgcctcgcgcccggccgaggaaatgttctttcgcaagaacggcctgctgttcatgtccccggccgagctggagcagatcgtcgagcgtctggtccaggcccaaccgctgctgggctcggtggccaaggaccccagtctacgcggcctgctgacctcggtggatctggtgctgcagggcattgcccacggtcaggcccagcccaaggacatcgagccgctgatcgcccagctggacaagcccgccgccgccatcgccacgggccatcaggcccagccggtggactggcagggcctgatgtcgggcggaccggccaaggatgcgccgcgccgctttttgatggtgcacggcaccctggattacggcgacctggagcccgcctccaaggtcatcgacgcggtgcgcgccacggccagggaccaggggctgacccccgagaacggcttcaaggtcagcatcaccggcaatctggccctgtcggacgccaatttcgccacggtgaccgaaggcgtcgagatttcggcgccgctgtcgttcatcgccgtgctgctgctgctgttctggggcgtgcgctcgggccgggtggtggcggccatcatgatcagtctggtggtgggactggtggccaccgccgccttcgccgccgccacggtgggcagcctcaaccccatttccgtggccttcgccgtgatgttcgtcggcatcgccgtggacttcgccatccagttcgtcaccgccttccgcaacgagcgctttctccagggcgagccgggcgccgccgtcctggcctcggcccgctccatggcggcgccgctgtcgctggccgccatcgccaccgccgtgggcttcctgtcattcctgcccaccgcctataccggcgtgtcgcaactgggcctgatcgccggcggcggcatgatcatcgccctggtggtggacttcaccttgctgccggcgctgctcgccctgctcaagccactgcccgaaaaggagccggtggggctcaagctgcaatccaccgacgccttcctgcgccgccatgccaagcgcatcgtcggcgtcggctgcgccgtcggtctggcgggcgcggttctgttgccggtcatgccgctggatttcgatccgctgcacctgcaggaccccaaggccgaggcggtctccgcctttttcgaactggccaagaatcccgataacggcgtctatgccgtcgagaccctggccccctcggtggaggccgcccgcgccctgaccgaaaagttcgaggcggtgcccgaggttcatcgggtgatgaccatcctgaccttcattcccgaagagcaggacgccaagctggccatgatcgccgatgtggccatggtgctggcccccaccctcaaccccgccaaggtgctgcccgccccgtcggccgaagagctgatggcggctctggccaagctggcggcgcaattggaggccgtcgcccccgaccacaagccctcgcaggttctggccggacatctgaaggccatcgtcgccaagggccccaaatccgccgaagcctatcagaaggccgccgccgccggcctgcccaccctgctgtcgggcctgcgccgctcgctggagcctgaactggtcagcctggacaccattcccgccgatctgaagcgcgaatgggtcgccgccgacggccgcgcccgcgtccaggtgctgcccaagatcgacatgcagaaccaggaggcgcgcaaccgcttcaacgccgccgtcaccgccgtcacccccttcatggccggcgcgcccatctccatggagcaatctggccgggtggtgatcggcgccttcgccgtggccggcatcggcgccctggtggccatcggcctgctgctgggcctgatgctgcgccgctggctggactcggccctggtgctggcgcccctggtgctgggcgccctggccacggtgatcgcggcccgtctggccggaatcgcgctgaacttcgccaatgtcatcgccctgccgctgctgctgggcatcggcgtcgccttcaacatctatttcgtggtcaattggcgcaacggcgtcaccgaccatctgtcgtcgcccaccacgcgggcggtgctgttctcggcgctgaccaccggttcggccttcggcagcctggcggtgtcgccccatctgggcaccgcctccatggggctgctgctgttcctgtcgctgggattgtcggtggcggccaccttcatcgtgctgcccgccatcttccacctgatcggcaagccgtcgtccaccgggtccgccctgtgagcaagcgcctgatcgtcaccgccgatgatttcggccgctcgctcgagatcaaccgggcggtggaggacggccatgccaacggcatcctcaccgccgccagcctgatggtcaccgaaggcgccgtggacgacgcggtcgagcgcgcccggcgcctgcctgggctgggggtcgggctgcacgtcaccctggtggacggcattcccgccctggcgcccagccagatccccgatctggtcgacgggaacgggctgttcaccctggatctggtccggctcggcacccgcatcttcctgtccaaggcggcgcagcgtcaggtcagcgccgagatgcgcacccagttcgagctgttcaaggccaccggcctgccgctcgcccatgtggacttccaccatcattaccatcagcaccccacggtcttcgccctggtgctggatctggcggtggagtacggggcgccgggcatccgcattccgtgggagccgccgctgctgtcctaccgggccaggggcgaccggctgggcacaaggctgtccaacggcctcttccactggcggcgcaaccgcgccatggcggccaaggccaaggccagagggctggtggtcaacgaacgggccttcggcctcaatgattccggccagatggatgccgccaaggtcaattccttcctgggcgtgctgcccgaagggctgtcggagatctattgccatcccgccaccgcccattggagcggggcacgccccatgccgccccattaccgcatcgatgacgagtacaaggccctgatcgccccggaaaaccgccgcaaggtcgaagagctgggcatcacgctgaccaccttcgccgcggaggctcggggacaatgaagggcaatcttctgcgcctggggctgatcgccctgatcatcgccgtggcctggtatatgcgcgacggcttcggcgacgtgggcggcgccctcaacaccgccggatggaccggggtggcgctgatggcactgacccacgcgctgcccgtggcgctgtgcggcgtggcctgggggctgttgcaggacgaggtgcccacctggaagttctcggtggcccgctggatcaaggacggggtgggcgagttggccggcattctgcccctgtcggcggaaatggccggcatccgcctgatgacccgctacggcttccgggtggccgatgccagcgccatcgtcatggtcgacctgaccgccgaggccatcgcccagttcttcttcagcatcctgggcgtcgccctgtggctgcacctctaccccgaggcagaggtcacccgctgggcgctgatcgccttaggcatcagcgttcccggcctggccatcttcgtcgccctgcagcgctcggtggtgatgcgtttcctggagaccctgccggccaagatcatgccccatgcctgggacgcccccgacgccgatgccggggtgcatgccgccgtcaacgcgctgtatgccgaccatggccgtgtcgcccgctcggtgttctggcacatcctggcctgggcggcgggggcgatcgaggcctgggtggcgctgcgcctgctgggctatcccctggggctggccgagattctggccctggaaagcatcatctacgccatccgctcggtggccttcgtggtgcccggcgccatcgggctgcaggagggcggctacatgctggtgggcgccgtgctgggcctgcccaccgagatcgccctggcggtctcgctgctgaagcgcgggcgtgagctgctgatgggcctgcccgccctgttcgcctggcactatatcgaacacgccaccgccaagcaaaaggccccggccgagaagaccggggcctgatgttttccccgcgcccgcggctcaggcgctgcggatttcgcggatgaagcccgccacctcctgggccaactggttcgaggcgcccttgaggccgttggcggcctcgtagacctgatccgacatcagcttggtctcctcggcggcccccgagaccacctcgacattttcggcggcggaggcggtgccgtgggccgcctgttccaccgagcgggcgatctcggcggtggcggcgccctgctcctccaccgcggcggcgatggccgaggacagctcgctgatattctcgatggttcccgagatggagcggatggcttccaccgccgagcgggtctcgccctgaatggcggtgacctgctggccgatttcctcggtggccttggcggtctggttggccagatgcttgacctcgttggcgaccacggcaaagcccttgccggcttcgcctgcccgcgccgcctcgatggtagcgttgagcgccagcaggttggtctggctggcgatgtcggtgatcaggttgaccacctcgccgatcttctgggccgcctcggcgaggctgcggaccatgcggtcggtctcgcccgcctgacgcaccgcatcgcccgagatggtggcggcatgggccacctgacgggaaatctcggtcaccgaggacgacagttcctgagtcgccgccgacaccgactggacattggcggtaacctgaccggtcatggcggtgacgttgccggcctgtaccatggtctgctgggcattggccgacagggtctgggcattgcccagcagcgagcccgacgacacgtcgatcagatcgaccacgcccttgacccggtcctccagggatttggcgacgcggttgagctcggccctgcggttctcctcggcctggcggtccagttcggccttttccagggcggaatagcccagcttggccttgagcgcccgcagcagcgaatggagctgcccgaattcctgcatgtcggccacggggatttcatgcgcctgattgcccgaggcgatggcgtcgaaatgccgctccatggccttcaggggattgcggatgcccgccaggatccagacggcgaggatgaagcccagaacgacggcaaccaccagggcgccgatcaccaggaatgtccgcgaggacagatgctgttcggcccgggcgtaggtattgccggcatccttgctctgatagtcgatcaaacccttgagagcgacatggttggcgttgtagagcggccgcatggcctcgccgaaatgcttggacagtgccgccgcatcgttcttgcggaccagatccaccgccggaatcagcccctggtcgcggaacgccgtgcgcgccttggcgaatttctcgatcagtgccagttcctcggccgggtggctgccctgggcatagtgctcccacttgcgattgatgatctgcgagttggactcgatggcggccagacgctcggacaccggcacccaatgctgattggccagcatctgcaccgcgatgctggcgatctggcgatagttttcctgggacagatcggcgacctcggccagatcgatggccggcatggtgttctccagatagacctcgcgcatgtcctcgccgatgccgcgcatgccggaaatgcccagccagcccaccaccagcatcagcactcccagcacggccagcactccggacaggcgtccggcgatggaattcttcagggcggaaaccctgccgcccaggccggtggagaccacccgcccgtcgcgaatggccaggccccgggccttgccttcacgaaacagcgcgtatgcctgttcggcggcattgatctgagcccgggtcggcttggagcggatggagatgaagccggcgatctggcccttttccatgaatggggtgacattggcccgcacccagtagtgatcgccggtcttggtgcggttcttgacgtagccctcccagggccgtccggccttgatggaggcccacagatcggcgaacgcctccttgggcatgtggggatggcgaaccagattgtggggcgagcccagcaattcctgctcggtaaagccgctgatatcgatgaaggccttgttcacgaaggtgatgcggccgccggcatcggtgcgcgacaccagcatgtcgtcgtccttcagttccacctcgcggttggtgatcgcgccgttgtcacgcatcggacactccctattttgtttggaccacccggctggacgatcgctcaagatcacgccgtttggcatataccatcaggcccttagaatggtacgcatacttacatattcaagccggcccgtcaaaatatcccactcggaaactcagatatctcggaaaagtttctgttgtgccctcccccatcccgccggtagggtccggcccatgagtgaagtgcagaccctgaccgtcgccgaggaagaggccgaaattcgcctcgaccgctggttcaagcgccatttcccctccgtcggccatgggctgctggaaaagtggctgcgcgccggcaatgtccgggtcgacggcaagcgcgccaaatccaaccagcgtctcgacgccggccagatcatccgcgtgcccccgctgcccacggccgaggcccctccgcgcgaggttcggcccgccccggtggacgagaagatcgcccgcatgctccaggacgcggttctgtacatggacgacgaggtcatcgcgctgaacaagccgcccgggctggcggttcagggcggcaccggcatggccgacaagcatctggacgcctggctggatgcgctgtgctttgacggcgggcggcccaagctggtccatcgcctggacaaggacacctcgggggtgctgttgctggggcgcaccgccaacgccaccgccaagctggccgccgccttcaaaagccgttcggcccgcaagtgctactgggcgctggtggccggcgtgccgcgctacccccagggccgcatcgacgcgcccctggccaagctgcccggcaaggccggcgagaaggtcgcggtggacaaggaggacggcaagcacgccgtcacctattaccgcgtggtggatgccaccctcaagcgcgccgcctggctggaactggagccgcgcaccggccggacccaccagttgcgcgcccactgcctgctgctgggcactcccatcatgggcgacggcaaatatggcggccaggatgccctggtcgaaggcaccggcgtctcgcgcaagctgcacctgcatgcccgcgccgtgcgcctgccccatccccgcaccggcaaggtgctggaggtggtggctcccctgccgccccacatcaaggccagcttcgacttcttcggctttaccgaaagccgctccggcccgccattcgtctccttcgaagacgattaagctccgtcatcattccgccgcattccggcggttggttgtgggctcccgatggggtagaataaccccacgcaatttaagatcagcgccccggagcccgatgtcccatctgcgccttgccgtcttcgatgtggatggcaccctggtggacagccagcacaatatcgtttcggccatgaccgaggcgtggagcaacttgaatctgggcatcccccggccggagcaggtccgccgcatcatcggcctgtccctggtggatgcctgcgccgtgctgctgccctgggcaacgcccgccgtccaccgcgccgtggccgattcctacaaggaagccttccgcgccatgcgcctgctgccagacaccatggagccgctgtttcccggcgtgaaggaggccctggacagactggaaagccagggctggcttttggggctggccaccggcaaatcgcgccgaggggtggattccatgctggaggcccatgacctggaagggcgcttcgtcactatccagaccgctgacgacaatcccagcaagcccaatcccgccatgctgcgccgcgccgccgccgattgcggcctggacctgcacgagatcgtcatgatcggtgacaccgcctacgatatggccatggcggcggccgcccgcagcgcagcggtcggcgtgtcgtggggctatcattcgctggacgagctgcgccgcgccggagcccaggtggttctcgacaccttcgaaaatctgaccgaggtcctggacaaggtcaccggggacatggcccaccaccaggccggagatggggaatgagggccagcacgattgccaagatcgttgccgcccttctcgtggttctggtggttgcggtggtcggggcgggaaagtccctgaagtccgaggcctataaccgcttcctggccgaacgggtcaaggccgccaccggattggacctctccttcgccggcgtcaccaagctcaagctgggaccgtcgccggtgctcagcttcaccggcgtgaccctgtcggcggcgggcggcaagggcggccccctcctctatatcgaccgcatcgaagcccgcgtcgccctggtgccgctggcgctgcgccagttgcggctggacagtatcaccctgatccgcccggtgctcgacctccggcaactgggagcgcttggccccactcgcccccttgatctgaccgaggcaccggcgggcgcgccgatcacccgcccagccctgtccgaactgcgaatcgaagatgcttctgtccgctggacggatggccacctgcaggtcgccaaggcgtcattccatccggaaaccgaggctggggggccattatcccttcagttggacggcatctggcagaatacacccgtcagcctgtcaggcgtcatcggcccattgtccagcctggcagggggcaagccatatcccgtgcagttcaagggaagcgtggggggcgccaatctgaccctgcgcggctccctggcggcaccgctggccggcaagggcctggatctggagcttcgtgcccagggcgaggaaatgtccgatttgttgcggctgggacccaccacggccactccccaggccttggggccgttcaagctggcaacccgggtgaccgatgccgccgggtcggtggcgttgtcggacctggatgccgtcatcggccgccgggacgcgcaactgatcactctcaagggtcaggtgggcgacgtgctcaggcgccgtggtatggacatgctggtgaccctggaatccgagtcactgagcctcctcatgcggatgctcagccaagacctgcccaatgccggaccggtaaagctgtccgctcatctgagcgacatcgaaaacggctggcgcctcaccggcctgaaaagcaatctgggcaaaagcgatctggctggtgaattgtccctggtccagaccccccgcccccgcctgtacggccgtctgtccgcctctcagcttttcctcggcgacttctcgctgccgcccccccgaagcggtggtcaggcccagccctcccagccccaacgtccggccattcccattgacgacggacgcatccttggagtcgacgccctggccctggacctgatcaaggatcttgacgccgccttatccatcgccgtcggccgcctccattggggttcgaccaccgtgaccgatgccaccgccgagcttcgtctcgccgccggccggctcggtctcgagaacttcgccgcccgttcgggcgacggacgtctgaatggagagatccgcctggatgccgccgccaagactccagccctggcgcttcgcctggcgggtgggagcgtcgatccgggcatgctgaccggcggtgcgctcaaggggaccaaggcggatttcgccttcgatctcaaggcccagggcaccaatatgcggctgctggccggcagcgccgaaggcagccttgtcttgaccctgggggaatcggtgctggacaaaggcaaggggggcgaactttccgcgcggctggcccgagatctagatcccgcgtcccaacgctccggggagcttcacttacgctgtctggtggctcggctgccggtcaaggccggcctgatcagcttcgataagggattgggtgccgaaacgccgtcatccgccgccctggcctccggctccatcgatctcagaaccgagtccctggacatcgctgtggccagccgcactgccccgctcctccgtgtcaggggcgtgctgggagccccggtggtctccagcgaaagcgggggcaagccgctggccgatgccaacccctgccgcaccgcccaggcccgccgcctgccccgttaagccacgccccatccacgaaggaccgttccgtgtcgtccaagtccatcaagcgcttttacaaggaatccgccgccgagcttcgtgacggcggcttcgccattctgctggacggcaagcctatcaagacaccgggggggcgtccgctctccgtcccggccaagccgctggccgaggccatcgctggggaatggcggagccagggagagcaggttcttccctcctccatgcccatgacgcaactggccagcaccgccatcgaccgggtcggccccgagcgtccccacatcaccggccagctcatgaactatgcgggcacggacctgctgtgctatcgcgccgagacccctggcgaccttgtggcccgccagaccgccgcctggcagccgctgctcgattgggccgcccaggccctggacgcccccctgctggtcaccaccgccctggcggccatcgcccagcccgacgcctccctggccgccctgcgacgccatgtggacgcctatgacgactggcggctcaccgccctgcagtcatcaaccgcggccatgggttcgctgatcctcggactggcgctgatggaaggccgactcgatcccgaagccgccttccaggcctcgcaattggatgagacgtaccagatcgaattgtggggcgaggactgggaagccgccgaccgccgcgccgagcttcggggcgacatcgacgccgccgcccgcttccgggatctgatcaccccctcttgaaggcgcaccagaagccaggagggccacgatgacgatcgatctccatggccacctcccgaaaccccgcctcggtcgccagtcggcgaagataggaccggctatgggcatactcgcccggcacggtcgccgccacctctcgcgggtcgcatagggggtccacggaaaacacaaagactccgcccggctccgtcaggcgtgacgcttcgcggaagaacggctcaagatcggcgaagtagtacagcacgcaagacgacagaatggtctcgaacggaccttcgatgcttgccagcccccccggcatctcgccctcgatcaaggtatcatagaccttgcgggcccgcgcctgcgccagcatgcccggcgagcgctcgatcccggtcaccgaagtggtagaggccggcagcttggaagccagcaatccggttcccgtgcccatttccagcacccgcctcatccgccgggcgggaaagtgcccctggtacagcctgagaagacgatcgctgaagtagttgtgcagctcattatcgtcatatcccaccgaaatggcatccagccgctccagtgtcacgccgtcgggggcgctaccatcccaatcgggcagcagttccgagaaaacctccaccgcctcttcatggcgccccagatggagcaaggcgatcgagagattgtgacgaacatagaaatcgcgggggagcacctcgcgggcctggctcagggtcgccaacgcgtcctgatagcgcccaagcgccgtctgagccatccccaaagccgccagaaagcgtttgtctccggcgatgacatgcttgtactcggcgcaaaccccgacgatgtccacataggcgcgcgcatggaccaaagcccaaacaagatcaaagatcgggtcgaccttgggatcggcccggaccagcccaaatagaatgcgggcggcttcggcgtactggccgaccttcagataggtttgcgccctcagacgcaagactgtggcgtcgccggggacagacgcttcgatccggtcgaaggccctcagagccccatcgatatcgtcctgcgcgacaagctccagagcggactgtatggcttccgttaacgtcatcaggccacccatcgccgccattgtgaaccaaatgtaaaccggcaaattcctcctgtcatcgaaaagaagccaccccaagcgaaaggggccgcccctcgcgggacggccccttcctaaagtctatgcaaccgaagcggagatttactcctcgtcagcatccgccttcttgtcggcggtggggccggaatcggtgcccttggcggccagatcgcgatcgaccagctcgatgatggccatgggggcgcaatcgccgtagcggaagccggccttcagcacgcggcaatagccgccctggcgctccttgtagcggggaccgatcactgcgaacaacttggcgaccaccttgtcgtcgcgcaggaaggcataggcctggcgacgggcgtgcaggtcgccgcgcttgcccagcgtgatcagcttctcgacgatgggacgagcgtccttggccttgggcagggtggtcttgatctgctcgtgcttcagcagggcgttcgccaagctgacgaacagggccttacgggccgacttgtcgcggttcagtttacggccggacataccatgacgcataacaactctcctcgtcgcttggcctcgtcgggcgagaccgattgtcgtaccgcatcgccacccctagggagagaacggcgcgggcggaccggaacggtccttaaaaaagcctacggcgcgacattggggccgatcaggcggccaatgtcgcgccgcaaacagatcagtagggctcttccagcttcttggccagctcttcgatgttctccggcggccaattggcgatttccatgcccaggtgcagacccatctgcgccagcacttccttgatctcgttcagcgacttgcgaccgaaattgggagtgcgcagcatctcggcttcggtcttctggaccaggtcgccgatatagatgatgttgtcgttcttcaggcagttggccgaacggaccgaaagctccagctcgtccaccttgcgcagcaggttcttgttgaagggcagttcgtccttcttctcttcctcgacgaccgcggtgggctcctcgaagttgatgaacagctgcagctggtcctgcaggatgcgggcggccagggccaccgcatcatccggcgtgaccgcgccgttggtctcgacggtcatggacagcttgtcataatcggtgacttggcccacgcgggtgttttccaccttgtaggccaccttgcgcaccggcgagaaaatggcgtcgatcgggatcagaccgatcggcgaatcctcgggacggttctgcgaggcggggacatagcccttgccggtctcgaccgtgaactcgatgttcagcttggcgccctcgtccagggtgcacagcaccagttcggggtccatgatctcgatgtcgtgaccaacctcgatcaagccggcggtgacctcgccggggccgacggcccggagatgcatccgcttcggcccctcgccatgcatgcgcaggcccagggtcttgatgttgaggatgatgtcggtgacgtcctcacgcacgccggggatcgacgagaattcgtgcagaacgccgtcgatctggatggcggtgacggcggcaccctgcagcgacgacagcagcacgcggcgcaaggaattgccaagcgtcataccaaagccgcgctcaagcggttcggcgaccacgatggcggtacgctgcggatcggccccgggctccacatggagcttgttgggcttaatcagttcctgccaattcttctgaatcacgtgcgtgacctcatgctaggaacaaaagaaaacgggaacgggcgtgccgccggtcttccctttcgcaaggaaggcggcggcagccctatcccaatgaaacccgatcagacgcgacgacgcttgcgcggccggcacccgttgtgcgggatcggcgtaacgtcacggatcgaagtgatctggaagcccacggcctgcaaagcgcgcagagccgattcacggccagcgcccggacccttcacctcgacctccaaggtgcgcatgccgtgctcggacgccttgcggcccgcgtcttcggcagccacctgggcagcgtacggggtcgacttgcgcgagcccttgaagccctgcatgccggccgacgaccaggaaatggtattaccctgggcatcggtgatggtgatcatggtgttgttgaacgtggcattcacatgcgccacgcccgaggtgatgttcttgcgctcgcggcgacggggacgcgcggcagcagcgggcttagccatcggaggtgttccttacttggtaactttcttcttgccggcaatcggcttggccggacccttgcgggtacgggcattcgtgtgggtgcgctgaccgtggaccggcaggccacggcgatggcgcaggccgcgatagcagcccaaatccatcagacgcttgatgttcatggccaccgaacgacgcaggtcaccttcgacctggaagtcgcgatcgatgagctcgcgaatcttgagcacttcgtcgtcagtcagctgattgacgcgacggtcgacgggaatccccagcgaagtggtgatctccgtcgccttggcgcgaccgatgccatgaatgtaggtcagcgcgatcagaacgcgcttattcgtcggaatattgacgccagcgatacgagccaaagctggttactccttcaccagaaaaaagaccgcgccacgattggacccggagccgttaaccaaaaacgcgcccctggcctcgcccatgacgggggaaaccgaaggtgcgggattatagggcgattcgatcaagagtcaaccgtctcgccctaccgaatcacattacttcgacgcgtccagaatcccttccagggccttggtcacgtcggcaatgtccatggtgccgtcaaccagcttcaaggagcccttcttgtcgtaatagggcagcagcggagcggtctgggcatgatacgcgtcgagacgcttggtcacggtgtcgacattgtcgtccggacggcgagcgaactcggtgccgccgcaggaatcgcacttgccggcgacctggggcagctgaaacttgtcgtggtagccggcgccgcatttagcgcaggtatagcgcccggtgatgcgctcgacgatataggcgtcggggacgcggatctcgatggcgaagtccagcttcttgcccttcttggccatcatggcgtcgagggcttcggcctgggccacagtgcgcgggaagccgtcgaagatggcgcccttggccacgtcggcctggtccaggcgctcatcgatgatggcgatgacgatctcgtcggacaccagctggccggcatccatcacggccttggccttcttgcccacttcggagccggacgccacggcggcgcgcagcatgtcgccggtcgacagttgcaccagaccgtacttgtcctgaagacgcttggcctgggttcccttgccgccaccgggcggacccaacagaacgagattcatcggatgtcccctttttcttggcagttaacgccgcccgcgcagccgggacttcttgatgagcccctcgtactggtgcgcaagcagatgcgactgaacctgagccaccgtgtccatggtcaccgacaccacgatcagcagcgaggtgccgccgaagtagaacggcaccgaaaacttgctgatcagcagctccggcaggatggacagcaccgacagataggcggcgcccaccacggtcagacgggtcaggacgtagtcgagataatcggaggtattcttgcccggacggatacccggaatgaagccgccgtacttcttcagattctcggccgtatccaccggattgaacaccacggcggtatagaagaacgaaaagaacacgatcaggctgaggtacagcgccagatacagcggctggccccggcccatcagggcggtgaaagtggtcagccactccggcccgcccgaggcggtgaactgggcgatggtcaccggcatcagcaggatcgagctggcgaaaatcggcggaatcacgccggaggtgttgaccttcagaggcagatgcgacgattcgccgccgaacatcttgttgcccacctggcgcttcggatactgaacgatgatccggcgctgagcgcgctccataaagacgatgaaggcgacaaccgccacgctcatcaccaggatgccgatgatcaccagcaccggcagggcgccagtacggcccaattccagggtgttgctgatggcggcgggcagttcggccacgatgccggccatgatgatcagcgaggtgccctggccgatgccgcgcgcggtgatctgctcacccagccacatcaggaagagggtaccgccggtcagggtcaccacggtcgagaagcggaacagcagatggctatccatcatcaccgcgctgccacgcgagctggtcatgccctcgagaccgacggcgatgccataggcctgcatcaccgcgatgaccacggtgagatagcgggtgtactggttgatcttcttgcggccggactcgccctctttcttcaccgcttccagcgacgggatgaccgtggtcatcagctggaggatgatggaggccgagatgtacggcatgatgttcagcgcgaagatggtcatacggtgcagcgcaccgccggccagcatgtcgaacatgccgagcatgccgccgcccgactgcttgaacaggtcgcccagcacatgcgggtcgacgccgggcatggggatccaggtgcccaggcgatagacgaccagcgccaacagggtgaaccagattcgcttcttgagctcggtggccttggcgagaacgccaaagttcagattcgaggcgagctgctcggcagcggaggccatgccttactccggggttcggtggcgcggggcgggcttaccccttcgcgaggctggcaccgcaccacaaatccttgatacagcccttgacccgggtcaatcgacccggaccggggattcgacgcatgaagggaaagaggggccttgcggcccctcaaccgcttcagccctcggcaacggccttgggcgcggccacggtcaccgagccgccggccttctcgacagcggcgatcgccgcggccgaggcacccgtcacctcgatagaaaccttggccttgatctcgccatggcccagcaggcggacaccgtccaggaccttgccgatgagaccggccgccgacaggatctcggcggtgatggtcgccttggcgtcgatgcgcttctcgtcgatggccttctgcaggcgaccgagattgatcacggcgaagtgcttggcgttcgggttgtgaaacccgcgcttgggcagacgacggtagatgggcatctgaccgccttcgaagccgttgatcgccacgccggtgcgcgaggtctgacccttcacgcccttgcccgaagtcttgcccttgccggagccgatgccacggccgaggcgcttcgactggtagcgcgcgccctcgttgtcgcgaagttcgttgagcttcatttcttttcgtcctcgtcacggtcggccggagctcgaaagctccggcccccggatgttctagtcttccacgcgcaccaggtggcggaccttggtgatcatgccgcgcaccgccggagtatcctccagctcgcgggtgcggtgcatcttgcccaggcccaggccgatcagagtggcgccctggtcggccggacggccgatggggctaccaatctgggtgaccttgacggtcgacttggcggcggtcttctgcttggcggccatattcaatgtcctcccaatcaaacgccggcggcagccgcggcggcggcaccgtcgcgacgaccgatgatctcgcccaccttcttgccgcgcttggcggcaacatggcggggagaagccaggttgatcagggcatcgaaggtcgccttgatcatgttgtgcgggttggaggtgccgaggcacttggccacgacgtcctggacacccatggtctcgaacacggcgcgcatcgggccgccggcgatgatgccggtaccggccggggcggcccgcaggatgacgcggccggcaccgaagtggccgtaggcgtcatgatgcagggtacgaccctcgcgcagagcgatcttgatcatgttgcgcttggcctgctcggtggccttgcggatggcttccggaacttcacgggccttgcccgaaccgcaaccaacgcggcccttggcatcgcccaccacgaccagggcggcgaaggcgaagcgacggccacccttcaccaccttggcaacgcggttgatatgaaccagcttgtcgacgaattcagattcctcgcgctcacgcggggtctgctcggcgccgccgcgaccgcgattgggccgatcgccgcgttcaccgccgcggccgcgctcgggacgatcagaagagggagtacgtgccattgctcatcatcctcagaaagacaggccgccttcgcgggccgcgtcggccagggccttgacccggccgtggtagatgtagccgccgcgatcgaacaccacctcggtgatgcccgccgccttggcccgctcggcgatcagcttgccgacggcggccgcagcctccttgtcggcgccggtcttcaaattgcccttgagctccttgtcgagcgtcgaggcagcggccagggtgacgccattgaggtcgtcgatcacctggacgtagatgttcttgccggagcggaagaccgacagacggatacgaccgttgcccttcttcttgatgctctgacgggcgcgccgcttgcggcgctcgaaaagattcttcggcgtcatcatggcggagccccttacttcttcttaccttccttgcggaggatagtctcggtttcatacttgatacccttgcccttgtagggctcgggaccacggaaagcgcggatttccgccgcgatctggccgacctgacgcttgtcgcggccggagatcgagatggcggtcggcttctcgcacttcatggtgacatcatccggaatgggatattcgatgtcgtgcgaatagccgagctgcagcttcagcgacttgccctcgaccgcggcacggtaaccgacgccgttgatctcgagattgacggtgaaaccgtcggacacgcccttgaccatgttgttcaggtgggcacgggtggtgccccacatcatgcgggcatgcttggtttcgttcttgggcttcacccagatcaggttgccatcgagggtgacctcgacgttgtccctgagagtgagcttggattcaccaagcttgcccttgacggtgacttcgggtccggtgatctgaacggtaacgcccgacggcaccgagacgggatatttgccgactcgcgacatgttgcggccctccgttagaacacttcgcagaggacttcgccgccgacattctgagtacgagcctcagtgtcggacatcacgccccgcggggtggagaggatggtgatccccagcccgttggcgacgcggcgaaggtcggcgatcttggaatacacgcggcggccgggagtggacacgcgcgagatttcccggattaccggctggccctcgtgatatttcagttcgatgctgagctgggcaacgcccggacgcagctcactccgggcatagccgcggatgtagccttcacgcttcagcacctcgagaacgttggcacgcaggctggacgccggcgaaacaacggtggacttgttggcccgctgcccgttgcgaatacgggtgagcagatcgccgagaggatcggtcatggacatgaggcgtcctcccttaccagctggacttgaccatgccgggaatctggccctgcgaggcgagctcgcgaagcttattccggcacagcttgaacttgcgatagttgccgcgcgaacggccggtgacttcgcagcgcagacgcacgcgaatcttggccgaattgcggggcagctccgccagcttcagggaggcttcgaagcgctcctccgggctggcttcacggttgttggcgatcgccttcaacttggcgcggcgggcggcgaactgggccgccatacgctcacgcttcttgttgcgctcgaccgagctgatcttagccattgcctaaatctccaatcaggccacgaacggcatgtcgaagcccttgaggagcgccttggcttcctcgttggacttggccgtggtgacgaagatgatgtccatgccccggatggtctcgaccttgtcgtagtcgatttcggggaagacgatctgctctttcagaccgagcgagtaattgccacggccatcgaagctcttgcccggaacgccgcggaagtcgcggacgcgcggcagggcgatgttgatcaggcggtcgaggaattcgtacatccgttcggcccgcagggtgaccttgcagcccacgacctgaccttcgcgcagcttgaactgggcgatggacatcttggccttggtgctgaccggcttctggccggagatcagggtcaattcggcgagggccgactcgatcttcttggaatcctgggcggcttcaccgacgcccatgttgatcacgatcttctgcagcttcggcacctgcatggggttcgcgtagttgaactccttctgcagggcgggcttgacgaccgtatcgtagtgcttacgcagacgtgccatctgtctgttccttcggcttaccggtcgatgacttcgccggagcgacgcgcgacgcgcaccttccgaccgtcttcgaggatcttgtgaccgatgcgggtcgccttgccatccttggggtcttcgtgggcgacgttggagacatggatcgacgcctccttctccacgatgccgccctgggaggtggcagacgggcgggtgtgacgcttgaccaggttcacaccctggacgatgacgcgctgctcggacggcatggcggcgatgacttcgcccttcttgcccttgtccttgccggcgaggacgacgacccggtcacccttcttcacgttcatggaagccatgattagaggacctccggagccagagagatgatcttcatgaacttcttgccgcgaagctcacgggtgacgggcccaaaaatacgggtgccgatcggttcgccctgcttgttgatcaggacggctgcattggtgtcgaaccggatcgcggaaccgtcggcgcgacggatttccttggcggtacgaacgatgacggcgcggtgcacgtcacccttcttcacgcggccacgcggaatcgcctccttgatggaaacgacgatgacgtcgcccaccgtggcgatggtccggtgcgagccgcccaacaccttgatgcactgcacccggcgggcacccgaattatcggcgacgtccaggttggtttgcatctggatcatgatgtctcttccttattcccagttcgcaaccgtcaagcctgcggctcgacgatcacttcccagcacttggtcttggagatcggcgcgcattcgcggatgcggatggtctcgccggtcttgaagacgttgttctcgtcgtgggcgtggtacttcttggaacgacggatgaacttcttgtagatcgggtgcatcacgcgccgctcgacgctgaccaccacggtcttttccatcttgtcgctcaccacgacgccctgaagaatgcgcttcggcatttgaatgggcctccttaggacgcgcttttggcgcgttcgccgagcagcgtcttgatggtcgcgatctcgcgacgcacagcacgcacccgggcggtattctccagctggccggaggcccgctggaagcgaagattgaactgctccttcttgagcgcaatgacctgctccttgagctggtcaacactcttctggcgcagatcggcagccttggtcgccatggctagatatccccgatccgagaaatgaacttggtcttgatcggcagcttggcagcggccagggcaaaaccgtgacgggcgatttcctcggcgacaccatccacttcgaagaggatgcggccgggagccacacgggcggtccagaactcgggagcgcccttaccggagcccatgcggacttcggcaggcttggacgagaccggcagatccgggaaaatgcggatccacacccggccctgacgcttcatgtgacgggtcagggcacgacgggcggcctcgatctggcgggcggtgatccgctcgggctccagagccttgaggccataggcgccgaaattcaaggcggagccacccttggtcactcccttgatccggcccttgtgggccttgcggaatttagtgcgcttgggcgaaagcatctctcaaacccttctcgatcaacggccggccggggcggtttcgcccgcagcccgcttgtcctgggccatggggtcgtgggcgaggatctcgcccttgaacacccaaaccttgacaccgcagcttccgtaggtggtgtgggcggtgcccacgccgtaatccacgtcggcacgcagcgtgtgcagcggaacgcggccttcgcggtaccactccatgcgggcgatttcagcgccacccagacggccggagcagttgatacgaatgccctgggcacccagacgcatggccgactgcacggcgcgcttcatggcgcgacggaaggcgacacggcgctcgagctgctgggcgatggactcggccaccagctgggcatccagttccggcttgcggatctcgacgatgttgaggtgaacctcgctaccggtcatcttcgagagctccttgcgcagcacctcgatatccgcacccttcttgccgatcaccacgcccggacgggcggtatggatggtgatgcgggccttcttggcgggacgctcgatgaccacgcgcgacacgccggcctgggccagcttctcgcgcaggtacttgcggagcttcaggtcctggtgcagcagcttggcgtaggtctcgtccgcgaaccaccgggaatcccaggtgcggttgatgccgacgcgcaggccgatcggattgactttctgacccatctgcttactcccccgccgcttcggcgcgttcgcgcacgatgacggtcagattgctgaacggcttttcgatgcggccgacgcggccacgggcgcgcgccttccaacgcttcatcaccatggccttgcccacgaaggcttcggccacgtagaggcgatccacgtccagctggtggttgttctcggcattggcgatggcggactgcagcaccttcctcacctcgacggcgatacgccgcttggagaaggtcagagcattcagagccacgtcggccttgagaccacggatgctttcggcaaccaggttgagcttgcgcgggctggtgcggatggaagccaggaacgccttggcctcagtgtccgccaggaccctatctgcgggtttcttgcccatggcttacttcctcttcgccttcttgtcgaccgcgtggccgtagaacgtgcgggtcggcgagaattcaccgaacttgtggccgatcatgttctcggtcaccagcacggggatgaacttctggccattgtagacgccaaaggtcagcccgacgaactgcggcaggatggtcgaacgacgcgaccagatcttgatgacctcgttgcggccgctggcgcgggccttgtcggcctttcccagcatgtagccgtcgaggaaggggcctttccaaacggaacgagccatttttcagcccctcctactgagtctgacggcggcgcatgatgagccggtccgtcttcttgttgctgcgagtcttcttgcccttggtgggcttgccccagggggtgaccggatgacggccgcccgaggtgcggccttcgccgccgccatgcgggtggtcgatcgggttcatggccacaccgcggacggaggggcgacggcccatccacacagcgcgaccggccttgcccagagagacgttctgctggtccgggttggacacggcaccgatggtggccatgcactcgccgcgaaccatgcggagttcgcccgaagccagacggagctgggcatagccctgatccttgccgaccagctggacataggtgccggccgaacgagccagctgaccgcccttgcccaccttgagctccacgttgtgcacgatggtgccgacggggatgttcttcagcggcatggcgttgccgggcttgatgtccgccttttcggaggcgatcacctggtcaccgacggccagacgctgcggggcgatgatgtaggccttctcgccgtcggcgtacgacaccagggcgatgaaagcggtacggttgggatcgtactccaggcgctcgaccgtggcggccacgtcgaacttattgcgcttgaagtcgatgatgcggtaacggcgcttgtgcccgccgccacgccaccggacggtcacccggccggtgttgttgcggccgcccttggagcgcagaccttcggtcaggctcttctcgggcttacccttccagagttccgaacgatcgaccaggaccagttggcggcggccaggcgtcgtcggcttgaatgtcttcagtgccatggcgtcagactcccgtggtcacgtcgatggagtggccctcggccagcgtcacgaccgccttcttgacgtcggaacgcacgccgggacggccgcggaagcgcttgaccttgcccttggcgatcagggtgttcacggcggtgaccttcaccccgaaaataccctcgacagcggccttgatctccgacttggtcgcatccagcggcaccttgaaggtgacctggcggaactcggagcccatggtcgccttttcggtgatcacgggggcgcggacgacgtcgtacatccgctccttgctgatgacgagcttgctcatttcaggcgagcctccagggcggcgaccgcgtccttggtcagaaccagggtgtcacggcgcaggatgtcgtagacattggcaccctgggtcggcagcacatccacgtaggggatgttgcggctggccagagcgaagttgccgtccacggcggcgccgtcgatgaacaacaccgagctcaggcccagcttgccgagacgggcggccaggtccttggtcttgggcgaaccggccgaggccgcgtccaccacgatgagcttgccgtcggcaaccttggccgacagggcagtcttcagcgccagcttgcggaccttcttgggcaggtcgtgagcgtgagagcgcaccaccgggccgaaaatggtcgaaccgccgcggaactgcgcggagcgcagcgagccctgacgggcacgaccgccacccttctgagcgaagggcttcttggtggtgccggagatctcgctgatcgtcttggtcttgtggttgcccgactggcgcttggccagctgccagttgacggcgcggaacaggatgtccccacgcaccggcacaccgaagatctcgtcggccagttcgatctcgccgacggtctggttgtccaggctgattacgttcgtcttcatcgccttgatcctttactcggccgaggccgcggccttgacgccggccgggaacggcacgccatcaggcagcttgcgcttcaccgcgtcgcggacgagcacccaagacccttcgtgaccgggaaccgaacccttaaccaggatcaggccgcgatcggcgtcggtggacaccacggtgaggttctgagtggtcacctgctcatcgcccatgtgaccggccatcttcttgcccttgaacaccttgccggggtcctggcgctggccggtggagccgtgcgagcggtgcgacaccgaaacgccgtgcgtggcttcgaggccacggaaattccagcgcttcataccgccggcaaagcccttgccgatggtggtgccggtcacgtccacgtactgaccggggatgaaatgggcggcggagagttcggtgccgacctcgagaaggttctcgggggcaacgcggaattccaccagcttcttcttgggctcgaccttggccttggcgaagttggcgcgagcgggcttgctcacattcttcaccttggcggtaccggcaccaagctgaacggcaacgtagccgtccttttccacagagcgggtcgagaccacctgacaggtgtcgaccttcagcacggtgacgggcacatgggtgccgtcctcggtgaagatcctcgtcatgccgaccttctgggcgatgagaccagagcgcattgttaggttccttagagcttgatctcgacgtcgacaccagcggccaggtcgagcttcatcagcgcgtccacggtctgcggggtcgggtcgacgatatccaaaagccgcttgtgagtccgaatttcgaactgctcgcgcgacttcttgtcgatgtgcgggctacggttcacggtgaacttctcgatccgcgagggaagcgggatcggaccgcgcacctgcgccccggtcctcttggcggtgttgacgatctcgcgggtggactggtccagcacgcggtgatcgaacgccttgaggcggatgcggatgttctggctttccatgttcaagtcatccgtcaaatcggaaaggcgccccgtcggggcgccgatcggtgaaaacagtaaattcaaagagcctcccgcagtcagctgcgatgccagtggcaaagccgctcttacggaatgaggccgaagccgaaggcagccttatacagagagtcgcctggggtggcaaggctgattcgactcgtttggcggggcgggccgagattcattccggcctccccaaaaagaggaaagggcgcccggttttacccggacgcccttcccgaaacagaagtccgaagactacttgatgatcttggccaccacgccggcgccgacggtccggccgccttcgcggatggcgaagcgcaggccctggtccatggcgatgggggcgatcagggtcacgatcatcttcacgttgtcgcccggcatcaccatctcggtgccttccggcagagcaaccacaccggtcacgtcggtggtgcggaagtagaactgcggacggtagttggtgaagaacggggtgtgacggccgccctcttccttgttcaggatgtaggcttcggcctcgaagtcggtgtggggcgtgatggagcccggagccgccagaacctggccgcgctccacgtcctcgcgcttggtgccgcgcagcagggcgccgatgttgtcgccggcctcaccctgatcgagcagcttgcggaacatttccacgccggtgcaggtggtcttgacggtgttcttgatgccgacgatctcgacttcctcgcccaccttgaccacgccacgctcgacgcggccggtcaccacggtgccacggcccgagatggagaacacgtcttcgatcggcatcaggaacggcttgtccttcggacgctccggctgcgggatgtaggcgtccacttcggccatcagcttcaggatggcgtcgcggccgatctccggctgcttgtcttccagggcacacagggccgaaccgcgcacgatcggaatgtcgtcgccggggaagtcatacgagctcagcagctcgcgcacttccagctcgaccagatccagcagctcgggatcgtcgaccatgtcgcacttgttcatgaacaccaccagggccggcacgccgacctgacgggccagcaggatgtgctcgcgggtctggggcatggggccgtcggcggccgacaccaccaggatggcgccgtccatctgcgccgcgccggtgatcatgttcttcacatagtcggcgtgaccggggcagtccacgtgggcgtagtggcggttgctggtctcgtactcgacgtgggcggtcgagatggtgatgccacgggccttctcttccggcgccttgtcgatctggtcgtaggcggtgaaggtggcgccgccggtctcggccaggatcttggtgatcgccgcggtcagcgaggtcttgccatggtcaacgtgaccgatggtcccgatgttgcagtgaggcttgttgcgctcgaatttagccttagccatcgtttcttactccgtcctcgataggtgtcagattagccggccagcttcgcgcggatctcgtccgacacgttctggggcacttccgaatagtggtcaaaagtcatgctgtactgcgcccggccctgggacatggaacgcagggtgttcacgtagccgaacatattggccagcggcaccatcgccgtgatcacacgggcgttgccgcgctggtccatgtcgttgacctggccgcgacggctgttcaaatcgccgatcacgtcgcccaggtaatcctcgggggtgaccacctcgaccttcatcatcggctcgagcagcttcggacccgccttggcgataccttcacggaaggctgcgcgcgaggcgatttcgaaggcgagaaccgaggagtcgacgtcgtggtaggcgccgtcggtcagggtggccttgaagtcgatcatggggaagccggcaatgacgccgttatccatggccgaccggatgcccttgtcgacaccggggacgtattccttgggaaccgagccaccgatgaccttgttctcgaagacgtaacccgcgcccttctcacccggctcgaagcggatcttgacgcgggcgaactggcccgagccaccggtctgcttcttgtgggtgtagtcgacttcgtaggccttcgagatggtctcgcgataggccacctgcggggcgcccacattggcttccaccttgaactcgcgcttcatgcggtccacgaggatttccagatgcagttcgcccatgcccttgatcacggtctggccggattccacatcggaggtaacgcggaacgagggatcctcggcggcaaggcgagccagggcgatgcccatcttctcctgatcggccttggacttgggctccaccgccacctcgatcaccggctcggggaactccatgcgctcgagcaccaccagcgagctgggggtcgggtcgcacagggtgtcaccggtggtggtgtccttcagaccggcgaaagcgacgatgtcgccggcgcgggcttccttgatttcctcacgcgagttggcgtgcatcagcagcatgcggccgacgcgctcgcgcttttccttcacggtgttctggatgtagctgcccgattcgaccacgcccgaatagacgcgcacgaaggtcagcgaaccgacgaaggggtcgttcatgattttgaacgccaggccagcgaagggctcgtcatcggtggagtgcttggcgatctcgtcctcggtgccgtacttcacgcccttgatggcgggaatgtcgaccggggccggcagatagtcgatgacggcgtcgagcaggggctgcacgcccttgttcttgaacgccgagccgcacagcaccggcacgaaagtgcgcgagatggtgcccttgcggatacaggcctgcagcacctcgaaggacggctcttcgccacccaggtactgttccatggcctcgtcgtccatctcgaccgcggtctcgatgagctgggcccggtactgggcggccttctcgaccaggtcggcggggatcggctgatcctcgaactcggcgcccaggctttcgtccttccagatcaccgcgacgttgcgcagcagatccaccaggccgatatagccgctttcctcgccgatgggcagatgcatgaccagcggacgggcgcccagacggtcaacgatcatatcgacgcagcgatagaagttggcgccgatgcggtccatcttgttgacgaagcaaatgcgcggcacgccgtacttgtcggcctgacgccacaccgtctcggactggggctcgacgcccgccaccgagtcgaacacggtcaccgcgccgtcgagcacgcggagcgaacgctccacctcgatggtgaagtccacgtggccgggggtgtcgatgatgttgacgcggtgatcacgccagaacgcggtggtcgcggccgaggtgatggtgatgccgcgctcctgctcctgctccatccagtccatggtggcggtgccttcgtgcacttcgccgatcttataggacttgccggtgtagtagaggatgcgttcggtggtggtggtcttaccggcatcgatgtgggccatgatgccgatattgcgataccgctcgaggggcgtggtacgggccatgttggtctcgctctccagttaccagcggtaatgggagaaggccttgttggcctccgccatacggtgggtgtcttcgcgcttcttgacggcggcgccacgattgttggcggcgtccagcagctcaccggacaggcggtcgatcatggtggtctcggaacgcttgcgcgagtaatcgatcagccagcggatggccagggcctgccggcgatcggagcgcacttcgacgggcacctggtaggtggcaccgccgacgcgacgcgagcggacttccagggccggcttcacgttgtcgagggcttcgtggaacaccttcagcgggtcctggccggtcttggcctggatcttgtccagggcgccgtagacgatggcttcggcggcggactttttgccgtcgagcatcaggcagttcatgaacttggcgacgacatagtcgtgaaacttggcgtcgggggtgatttcgcgcttctcagcggcgtgacgacgagacatctgatgaactccttacttcggacgcttcgcgccgtacttcgaacgacgctgacggcgatccttgacgccctgggtatccagcgtgccgcggatgatgtggtagcggacacccggcaagtccttcacacgaccgccacggatcatcaccaccgagtgttcctgaaggttgtgaccttcgcccggaatgtacgaggtaacctcgaaaccgttggtcaggcgcacacgggcgaccttacgaagcgccgagttcggcttcttcggagtggtcgtgtacacgcgagtgcaaacgccgcgcttctgcgggcaggcctccatggcggggaccttgttgcgcgccgccacaggctggcgcggcttacggatcaattgattgatcgtgggcattcagtcactttcccttcacacaggtcccttgacgaaaaccagaaaaaaacccgccggcagttccccgccggggttttcttggggttcagtcgccgacctgttcggcgttgtcatcagtgtttcgcaagcctcgggacaacgaaaaccgtccaggcggacggataccggtcccccgagaagcgcgcatcctatttatccgcccgccccccgtcaagcgaaagagtcgggacatttccccttccaaattcaatcgccgcgagtcgattcttggtaacctttccatgctatggtgagggtggtttggactccgaggctcgccatgcagaccccgaccgccgagatgacaggttcgctttccatcgagacccccgcccgcccggggcgtgtcgtctctggaatcaaggaggccgccgacagcacgggcgtgtccttcggctacctcctggctcaggccacccaggaaagcgggctggatccccaggcccgcaacaccaagtcctcggcgtcgggcctgttccagttcaccgccggaacctggctggacatggtcaagcgccatggcgccgagcacggcctgaacgatgcggccgaggccatcgtcaagggcgcagacggtcgcctggatgtggctgacaagtccctgaagaaggccattctcgacctgcgcaaagaccccaagctgtcctccctgatggccgccgaattcgccaaggacaacgccaagaccctggaaaagcgcctgggccgcgaggccaccgcctcggacctctacctcgcccacttcctgggcgccgccggcgccgcccgggtgatcgagggcatggaggacaacccgaagcattcggcccgccacctgctgcccgatgccgcccgggccaacccggaagtgttccgcaaagctcacaccgtggcgggtctttataaaagtgtgcaggcccgcttcaagagcgcgctgggcaacgacgccgccgccgcccatcagcccgccgtcgatactggcaatccgcagctggcggccctgcgccccgtagcccggcccgaggcccctcccccgtcgaccccgaccgaggccgcgctcacccaggtggtgcaggcggtggccccggtcacccaggcggcggtgcgcagcgtgtcggccgccgacttcgccactgcgctgcagccggacagcccgttcttccccgccgccattccctccgcccccacgggcaagagcccgcagaccgtcagcctgcgcgacatcgtggaatccatcaaggcgggaggagaagtctaaggcgggttgccgcccggggcgatgccccggccccccttttgattttatgaataaataatggagaggtttggagacctggtctccaagcggggtcggggcggcagccccgcttagccccacatgaacctaaaatacccgccaggaatgactgaacgccgccgtcagtcccatgccggccagccacaggggaacgggtagagcgaggacgggcagataccagccacattcgcgataggtcaggcgatccacgatcgaggccttccccaccaggcgcagaccggcgggattgacccattcataatgcgtggttcgcagccgcagccccagatcgagcaatccgatcacacccggccccatggcggcggcgaccgtggcggccacgggccagggcgggcccagggtccagaccagcccgaagatggtcgcgaaatagacaatcaccaggggcatccatttgggaagccccagtcccagcggccccaggggcaggacgatgaaggaatcgtcgcgccccacgcgcttggcggccgtcaccggaagaaatcctcggcggcgatggcgaagttgagtccgtcggcgtcgcggatgtgaaaggtggtaatgcccaccagattgcccgccgagtcgaacagccctccccccgaggacccctgggaaatgggggccgtggtctggacgtagcgcaggcccttgatggtccgcagtcccgagaccaggccttggcccaaggtcgcctccagtcctttgggcgcgccgatggaatagaccgtctcgcccacccgcagatcctcccaggcgcgaattcccgggacagccgacagacgcccgggcgaaacggtcatcaggcagcggtcggtggcctcgtccccgcccgatggcgtcgcccgcatggtctgcccgccctggcgcagcagaatcaccgacatctcgtcgatgacgtggcaattggtcaccacggtgcgttcatccatggccaccgccgacccgaaacggccctttttggccctcagttcgtcttcggtgcgggcggcgatcaccacatagaccgaccggcccaccgtggcgaacacgtcctcggcccccaggcgcgaccggcccgccggccgctgcaacgacgcggcaagcggccgccagtccggcagcttggccgcggcgccggagcccagcccgaccggcgtcacgccgatggctggaggcgcctccaccggcccctgacgctcgggcatccgaccgggcttccacgccgccgccgactcctccacccgcccccgcaggtccgacgccagattgtgggccagctcctgccgcaggaagtaggcctcgctggtgcaatcgcgatagtgaaagcggttctcgaacagggggtgatcctcgggcggcggctcgtttcgtcccgccagccccgccacattggcccaatagagggcttgcgagcggttcttctcgacccagccgccccggtcgtggccatgggcgaggcgcaactgggctagacaattgccctcggccgccaggccgttgtacaggtcggcggcgaggccgggctcctccccttccgccaggacggcccgcaccagccgagcccactgggctccgcccgccaccgccttggccagataggtcctggccttggccagatccttgggcgtgccgcggccataccagtgggcatcgaacagacgacgcaacgccagaccgtctcctgcggcggcggcctgctcccaccaggacaaagccgtggcgggatcgtaatggcgctgggtgggatcgcccatcacatcgcccaacatccgggcggcaacggaatcgccggcggcggcggcggtggagcattgggccagttcggcagtggacgacgggcgcgccaaacaggccgcctggacgggcaacgcgccgcccatggcgatcagcatcgccatcgtcttgccccaccgcgagctcatggcttctcccttgacgctccacccgggttgtggcgccccgggatttacaaggaagatgatagcgccttggccgcttaaggtcttcaccctatttagaaacgtcaaaaaaagtcatccccgcctccttttcaggaagcggggatgctaccgttaccagtctccagcgcgccttactcggcgggcggagcctccggcgccgagccctcggccaccggcggaatggcaggaacctcggattcgccttccacctgcatgtccttgtcgcgcttggcggcaatggcgcgcagacggttcatcaccgcgccggtaccggcggggatcagacggccgacgatgacgttttccttcaggccctggagcgagtccaccttgccggacacagccgcctcggtaagcacgcgggtggtctcctggaaggaggccgccgagatgaaggaatgagtctgcaagctggccttggtgatgccctgcagcaccggagtgcccgaggccggacggccctgctcgcgaatggccttcgagttctcgatatcgaactcgacgcggtccacctgctcgcccaccagaagtgtggtgtcgcccggatcggtgatctcgaccttctgcagcatctggcgaacgatcacctcgatgtgcttgtcgttgatcttcacgccctgcagtcgatagacctcctgaatctcgttgatgagatactgggccagggcttcgacgcccaagaccttcaggatgtcatgcggcacgggattaccgtccatcagcgggtcgccgcggcggacgtaatcgccttcctgcaccgagatgtgcttgcccttggggatcaggtactcgatggcatcgccctcttccgggaccaccagaatacggcgcttggacttgtagtccttgccgaattccacgcggccgtcgcaatcggagatgatggcgtgatccttgggtttacgcgcctcgaacagctcggccacacgcggcagaccgccggtgatgtcgcgggtcttggacgattcacgcggaatgcgcgccagcacgtcgccggcgttgaccttggtgttgttctccaccgacaggatggcgtccacgctcatgaagtagcgggcctccagaccgttggcgagcaacaactcctcgcccttctcgtcacgcagggtgacgcggggacggagatcggcgccacggggctgctgcttccaatcgaccaccaccttgctggcgatgccggtggcctcgtcgaccacctcgcgcatggacaggccttcggtcaggtcgacgtaatgggccacacccgcgcgctcggtgatgatcggcagggtgtaggggtcccattcggccagcttggtgcccttggtgaccttctgggcctcgtccaccagcagcttggcgccgtaggggacgcggtgacgggcacgctcgcggttgttgatgtcgagcagggccacttcgcaattacggctcatgacgatggaagcgcccgacgagttgaccaccacgttgcggttgatcacctggacggtgccatcgaaagtcgcctcgatggaggactgctcggcaccgcgctgcgccgcgccaccgatgtggaaggtacgcatggtcagctgggtacccggctcgccgatggattgggcggcgatgacgccgaccgcttcaccgacgttgacgcgggtgccgcgggccagatcacggccgtagcacgagccgcagacgccctcttccgagtcgcaggtcagcaccgaacggatcaccacggtctcgatgccggcggcgtcgatcagctcgacctcggtctcctggatcatctgggccgccttgacgatcacttcgccggtcagcggattgacgatgtcacgcgccgccgaacggccgaggatacgctcggccagcgaagcgatgacctcgccgccctcgatcaccggagagacggtcaggccgttggtggtgccgcaatcctcttcgcagatgatggcgtcctgggccacgtccaccagacgacgggtcaggtaacccgagttggcggtcttcagcgcggtatcggccagacccttacgggcgccgtgggtggagttgaagtactccagcacggtgaggccttccttgaagttcgagatgatcggcgtctcgatgatctcgcccgagggcttggccatcaggccgcgcatgccggccagctgcttcatctgggcggcggaaccacgggcgccggaatgggccatcatgtagatggagttgatctgcttgcccggaaccaggctggagatctgcttcatcatggcgtcggcgacgtcgtcggtgcacttggaccaggcgtcgacgaccttgttgtacttttcaccctgggtgatcaggccgtcctggtactgctgctcgtattccttggccttctcttcggtctcgcccaccagggtttccttttccggcgggatgaccaggtcgtccttgccgaaggaaatgcccgccttgaaggcgttggaatagcccaggcccatgacgcggtcggcgaagatcaccgtctctttctggccgcaatggcggtagaccacgtcgatgacgttttggatttccttcttggtcaacagacggttgatcaaggagaacgggacgttcttgttcttgggcaggatcaccgagagcatcatgcggcccggcgtggtgtccacgatctgggtcaccggggtgccttcggaatccacggtgtcgaagcgggcacggatcttggtgtggagcgtgatcgtcttttcggtcagcgcttcctcgatctcggccatgttcacgaagaccggcaccttgaacaggatggccttgccgtccttgatggccttctcggcgtcgttgacgtcggcgaagaccagcgggacgccgggcttttccacattgaacaggcgcagatggccgcccttcaggccggcttccagtgcgtccttggacgacgggttgacgcggcggtgggcggtgacgttgcggctggccagacggtccagcagggtatccagatccttggtgtcgatcttggtgttgggatcggtcgggcagtagaacaggatcgcgttgttggcgatggcgcccttcagctcgtccatggagcggatcttcagcacctggccgggaacctcgtcccgttccatggtgatgtagtagatgcccagcacgatatcttgcgacggcacgatgatcggcttgccgttggcgggcgacaggatgttgttggtggacatcatcagcacgcgggcttccagctgggcctcgaggctcagcgggacgtgcacggccatctgatcgccgtcaaagtcggcgttgaaggcggtgcagaccagcggatgcagctggatggccttgccctcgatcagcaccggctcgaaggcctggatgcccagacggtgcagcgtcggcgcgcggttcagcatcacgggatgctcgcggatgacctcttccaggatgtcccacacctcgggacgctccttttccaccatgcgcttggcggccttgatggtggtggccatgccgtagagttcgagcttcgagtagacgaagggcttgaacagctccagcgccatcttcttgggcagaccgcactggtgcagcttcagctctggaccgaccacgatgaccgaacggccggaatagtcgacgcgcttgcccagcaggttctgacggaagcggccctgcttgcccttcagcatgtcggacagcgacttcagcggccgcttgttggcgccggtgatggcgcggccgcgacggccgttgtcgaacagggcgtcgaccgcctcctgcagcatgcgcttctcgttgcgcacgatgatctcgggggcgcgcaattcgatcagccgcttcagacgattgttgcggttgatgacgcggcggtacaggtcgttgaggtccgaggtggcgaaacggccgccgtccaggggcaccaggggacgcagttccggcggaatcaccggaatcacttccaggatcatccattccgggcgcgagccggattccatgaaagcctcgaccagcttcatgcgcttgaccagcttcttgcgcttggcctcggaggtggtctccttgaggtcgaccttcaactgggccttctcggtctccagatcgataaccgtcagcatgtcgcggatggcctcggcgccgatcttggcggtgaaggcgtcctcgccgtactcgtccacggcgcgcatgtactgctcttcggtcagcagctcacggatcttgagcggcgtgaggccgggctcgaccaccacgtaattctcgaagtagagaatgcgctccagatccttcagggtcatgtcgcacagcaggccgatacggctgggcagcgacttcaggaaccagatgtgggccacgggagaggccagctcgatatggcccatgcgctcgcgccggaccttggccagggtgacttccacaccgcacttctcgcagatgatgccgcgatacttcatgcgcttgtacttgccgcacaggcactcgtagtccttgatcggcccgaagatgcgggcgcagaacaggccgtcgcgctccggcttgaaggtgcggtagttgatggtctccggcttcttgatctcaccgtacgaccaggagcggatacgctccggcgaggcgatggagatgcggatctggtcgaacgactgagtgccgctcacctggccgaagatcttcataagttcgttcatcgacaaactcccgtgtgacctttgagggcggcgggggaagagaagcttcccccgcgccgggtccgtaaaatgcttagtagttccgctgggtcagttcgacgttcaggccgagagagcgaagctccttgaccagcacgttgaacgactcggggataccggcctcgaaggtgtcgtcgccgcgcacgatggcctcgtagaccttggtgcggccggaaacgtcgtccgacttgaccgtcagcatttcctgcaaggtgtaggcggcaccgtaagcttccagagcccacacttccatttcaccgaaccgctgtccgccgaactgcgccttaccgcccaggggctgctgggtgaccagcgagtacgggccgatggagcgggcgtggatcttgtcgtccaccaggtggtgcagcttcagcatgtagatgtagcccaccgtaaccttacggtcgaacggctcgccggtgcggccgtcaaccagggtcacctggccggaggaggaccggcccgccttggtcagcatggcgacgatgtcgctttcgcgggcgccgtcgaacaccggggtggcgatcggcacgcccggagtcaggttgtgagccagttcggtgatctcgttatcggccaaaccggcgatctcgtcctcatagatggcgtcgccgtagacgtccttcaacttggatttcagatcaatgatggtcgcggcgttgcgcttgtacttgtcgagcataccgccgatctgctggcccaggccggcgcaggcccagcccagatgggtctcgagaatctgccccacgttcatgcgcgacggcacgcccagggggttcagcacgatgtccacctgctggccatcttccagatagggcatgtcttccagcggaacgatgcgcgagatgacgcccttgttgccgtgacggccggccatcttgtcgcccggctgcagcttgcgcttcaccgccacgaacaccttgaccatcttcatcacgccgggcggcagctcgtcgccgcgctgcagcttctcgaccttgttctcaaaacgctcctgcagcttgtcgacctgctggtcgaaagcgcgcttcagcgcctcggcatcagccatcaccgcatcgtcgtcgatggcgatgttgcgccaggtgctgggatgcagctcgtccatgttggcatcggcgagaacggtgccggccttgatgcccttgggacccgagacgaccttcttgccgatgatcagcgccttgagacgggcgaagaacgaccgctccaggatgtgacgctcgtcatcgcggtccttggccagacgctcgatttccgcccgctcgatggccagggcgcgttcgtccttctccacgccgcggcgcgagaagacccgcacctcgacgatggtgcccgacacgcccggaggcagacgcagcgaggtatcgcgaacgtccgaggccttttcgccgaagatagcgcgcagcagcttctcttccggggtcatcggcgattcgcccttcggcgtcaccttgcccaccagaatgtcgcccggcttcacctcggcaccgatatagacgatgccggcctcgtccaggttcttcagagcctcttcacccacattggggatgtcgcgggtgatttcttcctggcccagcttggtgtcgcgggccatgacttcgaattcctcgatgtggatcgaggtgaagacgtcgtcacggacgatgcgctcggagatgaggatcgaatcctcgaagttgtagccgttccagggcatgaacgcgaccagcacgttgcggcccagggccagttcgcccagctgggtcgaggggccatcggcgatgatgtcgcccttctggatcagatcgcccaccttcaccagcggacgctgggtgatgcaggtgttctgattggaacgctggaacttcagcaggttgtagatgtccacgcccgaagccgacgcctgggtctcctcggtggcgcgaatcaccacgcgggtggcgtccacctgatcgaccacgccggtacgcttggcggtgatggcggcgccggagtcacgggccaccgcctgctccatgccggtgcccaccaggggggcctcggcgcggatcagcggaaccgcctgacgctgcatgttcgaccccatcagggcgcggttggcgtcgtcgttctccaggaacgggatcagcgcggcggccaccgaaaccaactgcttcggcgacacgtcgatcatgttgatctcgttgggcggaaccatgacgaagtcgccggcccggcggcacgacaccagatcctcggtgaagcggccatcggcgtccaggatggaattggcctgggcgacggtgtagcgcccctcttccatggccgaaagatagaccacgtcgctggtgacccggccgtcgaacaccttgcggtacggcgcctcgatgaagccgtactggttgacgcgggcataggtggccagcgagttgatcagaccgatgttcgggccttccggcgtctcgatcgggcagatgcggccgtaatgggtcgggtgcacgtcgcgcacctcgaagccggcgcgctcgcgggtcagaccgcccggcccgagggccgagagacgacgcttgtgggtgatttccgacagcgggttggtctggtccatgaactgcgacagctgcgagctgccgaagaactcgcgcacggcggcggcggccggcttggcattgatcaggtcatggggcatgaccgaatcgatgtccaccgacgacatgcgctcgcggatggcgcgctccatgcgaagcaggccgacgcgatactgattctccatcagctcgcccaccgagcggacgcggcggttgcccaggtgatcgatgtcgtcgatctcgcccttgccgtccttcagctcgaccagcaccttgatgacgcccaggatgtcttccttgcgcagcacgcgcacggtatcggccacctcgggggtgttgaggcgcgagttcatcttgacgcggcccacggccgacaggtcgtagcgctcggagtcgaagaacaggccggtgaacagggcctcggcggtttcgagagtcggcggctcgcccggacgcatcacacgatagatgtcgatcaaggcctcttcgcgcgaagagttcttgtcgatggccagcgtgttgcgcatgtacgggccgacattgatgtggtcgatggccagcaccggcagttcgctgatgcccgccttctccagctcggccaccagattggctgtcagctcgtcaccggcctcggtgaagatctcgccggtctgctcgttgatgatgtcctcggccacatactggccgatcatgtcctcggggaagacaacgatgtcggtcaggccggcttcgcgcagcttcttgcccaggcgcggcgtcatcttgctgccggcatcggccaccttctcgccgctcttggcatcgatcaggtcggagaccagcttgacgcccttcaggcgctcggcatcgaacggggtcttccagcccttggggccgcgggtgtagaccaccttgccgtagaagtaggacaggatctcttccgaggtcatgcccttgatttcgctctgctccaggccacggccctcggcggcgcgctgggcgcgcagcgctgcggtgttcatgccgtccagcgcatacagcagcgtggtcaccggcagcttgcggcgacggtcgatgcgcacatagaccaggtccttggcgtcgaactcgaagtccagccaggaaccgcgatagggaatgacgcgggcggcgaacagatacttgcccgacgaatgggtcttgcccttgtcgtgatcgaagaacacgcccgggctgcggtgcatctgggagacgatgacgcgttcggtgccgttgatcacgaaagtgccgttcgacgtcatcaggggcatgtcgcccatgtagacgtcctgctccttgatgtcgcggatggagcgcgagccggtatcctcgtcgatgtcccacaccaccaggcgcagagtcaccttcaagggcgccgcgaaggtcatgccgcgctgctggcactcctcgacgtcgtacttgggctgctccagctcgtagcgcacgaactccagggttccgcgctcggagaagtccttgatggggaacacggacttgaagacttcctgcaggccgacattgccgcgctgctcgggagccgtgtccatctggaggaaatgatcgtaggagcttttttgcacctcgatcaggttcggcatcggcgcaacggtcggaatccgcccgaagcttttgcgcacacgcttgcgacccgtataggatttagccattgccgctcctcgtcctcttcgtggggtttagcccaacaaatctcgtcctgcccggggaccgcccgggatgccccctgcggggccccaccccttacgggtgggttttgaccacccgtaaggatgatcggtaaagcgccagaaggccgggatgcgaaaaaaccgcatcccggcccctggataaacaccagaaggcgttcttacttgacctgcaccttggcgccggcctcttccagaaccttcttgatcttctcggcttcgtccttgctgacgccgtccttgacggacttcggagcggcctcgaccagatccttggcttccttcaggcccaggccggtgatggcgcggacttccttgatgacgttgatcttcttctcaccggcatcggtgaggatcacgtcgaactcggtctgctcttcggcagccggagcagcggcgccggcggccacggcggccacggcaaccggagcggcggcggaaacgccccacttctcttccagcagcttcgagagctcggcggcctcgagaacggtcagggcggacaggtcgtcaaccaacttggcaagatcagccatttaaaacactcctagtaaaagcttgaagcttgggattgggtcaaaaatctcacgcggcgtccttgtccgccttggccttcaggacgcgagccaactggcccgcgggcgcctgaagaacgccggcgatacgggtagccggggtcgagagcatgccgagaagcttgccacgcagctcgtccagggacggcagggtggccagcgccttgacgccgttgacgtccaggcgcagcgagcccagcgatccaccgaggatcttgagcttgtcgttagccttggcgtaatcggcaacgaccttggcggcggcaaccggatcgcgcgaaacggcgatggcggtcggaccgacgaaaagatcggcgatgctttcaaactcggtacccgcaagggcgagcttggtgagacgattcttggtcactttgaagctggcaccggccgcccgcatcttcccgcgcagatccgtcatttcggcaaccgtcaaacccgaataatgggtgacgaccaccagcccgacgtctccgagcgttccctgcagcgagccgacccactctgtcttctgtgtccggtccactttcgtctccaaacatagagccgaaacgtccccgccatcatggcggctggttccggtccattgcccatggccctgtcggacggcattgccgcccggcaaagccggtggcctgtcccagaagcttcaagccgtgccgggcccctttggggggaacggcaaacgtcttcttgacctctgtctgcgcaggcgggaaatcccttcaagcccctgtaagggggcacctacggtctcggacaggatggaagcccccttgataaggagacttccgccttctcccctccccctcgcgggggacgggaaactcttgccccccagcctttaggccagggtggcgacgtcgagcttaacgcccgggcccatggtcgagctcagcgacaccttcttgagataggtgcccttggcgccctggggcttcgccttggtgatggcatcgacgaacgccttgacgttctcggccagcttctcttccgagaacgaggccttgccgatgccggcgtgaacgataccggccttctcgacgcggaactggacctgaccggccttggcggcacggacggcttccgtcacgttggcggtcacggtacccagcttcgggttcggcatcaggccgcgcggacccagcaccttgccgagacgccccaccagacccatcaggtcgggggtggcgatgacgcggtcgaaatccatgttgccggcgttgcaggcgtcgaacaggtcctgctcgccgacgatgtcggcgccggccttgcgggcctcctcggccttgtcgcccttggcgaacacggcgacgcggacggtctttccggtgccgtggggcagttcgaccacgccacggaccatctggtcggcgtgacgggggtcgacacccaggttcagggcgatctcgatggtctcatcgaacttggcgacggcgcgggtcttgatggccttcaccgcatcggcgaggctgtagaacttgtcgcggtcgatatcggcataggccgacttcaggcgctttccttcgcgagccatgtgcttactccaccaccttgaggcccatggaacgggcggaaccgacgatcatcgtggacgcggcctcgacgtcgttggcgttgagatcgaccatcttcttctccgcgatctcgcggatctgagccatggtcacctcgccgacggtggcgcccttgccgggcgtggtcgagcccttggacaccgcggcggccttcttcaggaagtagctgaccggcggggtcttggtcacgaaggtaaaggtacggtcggaataggcggtgatcaccaccggaatcggcatgccgggctcgagagcctgggtctgggcgttgaacgccttgcagaattccatgatgttcaggccgcgctgacccagcgcgggaccgatcggcggcgagggattcgccttgccggccggaacttggagcttaacgtagcccacgatcttctttgccatgtcacaatcctctctctgtcaccagagttggcggtgcggcgttggcgcgcctcccgccctccaaaccggccccggacatccgggacacggaaaacaaaaagcaccggtgccgcccgcgccatttcggcggggcggcttccggtcacatccctcagatcttttcgacctgagagtattccagttcgaccggggtggagcgaccgaagatcgagaccgccaccttgaggcgggccttctcctcgtcgacttcctcgaccaggccgttgaacgaggtgaagggaccgtccgagacccgaacctgctctcccacctcgaagatgatggagggcttggggcgctcgacgccttcctgcacctgcttgatgatgcgctcggcttcgcgctcggtgatcggcacgggacggcccttgccgcccaggaagccggtgaccttgggagtgttcttgaccagatgccaggtgtcgtcggtgaggttcatcttcaccaggacatagcccgggaagaatttgcgctcggcgttcaccttggcgccgcggcgaacctcgacgacttcctcggtcggcacgagaatctgctcgaaagcctcggccatgcccttctgttccgcctgttcgcggatggactgggcgaccttcttctcgaagccggaatagacgtgaatcacgtaccagcgggcggtagtcatctcgtcctcagcctcccagaccgaacaggagctttacgctcgcggcgaaaatctggtcgacgaccaggaagaagacagcggcgatcaccaccatcaccaccaccatgccggtggagacggtcgtttcgcgccttgtcggccaagtcaccttggcgacttcctggcggacctgcttgaagaaaagggccggagacgtttttgccatatctctacagtcgaaagttggcaggagtggaggggctcgaacccccaacccccggttttggagaccggtgctctaccagttgagctacactcctgcagccttcaccggccccacatcagggaccaggatcagaccagacgtgaccggagccacgccttatacagacactcgacgaccttggcaacaccgccgaaacggtgcggccaaggccggatcgagagagttacttgatgatcttggccaccacgccggcgccgacggtccggccgccttcgcggatggcgaagcgcaggccctggtccatggcgatgggggcgatcagggtcacgatcatcttcacgttgtcgcccggcatcaccatctcggtgccttccggcagagcaaccacaccggtcacgtcggtggtgcggaagtagaactgcggacggtagttggtgaagaacggggtgtgacggccgccttcttccttgttcaggatgtaggcttcggcctcgaagtcggtgtggggcgtgatggagcccggagccgccagaacctggccgcgctccacgtcctcgcgcttggtgccgcgcagcagggcgccgatgttgtcgccggcctcaccctgatcgagcagcttgcggaacatttccacgccggtgcaggtggtcttgacggtgttcttgatgccgacgatctcgacttcctcgcccaccttgaccacgccacgctcgacgcggccggtcaccacggtgccacggcccgagatggagaacacgtcttcgatcggcatcaggaacggcttgtccttcggacgctccggctgcgggatgtaggcgtccacttcggccatcagcttcaggatggcgtcgcggccgatctccggctgcttgtcttccagggcacacagggccgaaccgcgcacgatcggaatgtcgtcgccggggaagtcatacgagctcagcagctcgcgcacttccagctcgaccagatccagcagctcgggatcgtcgaccatgtcgcacttgttcatgaacaccaccagggccggcacgccgacctgacgggccagcaggatgtgctcgcgggtctggggcatggggccgtcggcggccgaaaccaccaggatggcgccgtccatctgcgccgcgccggtgatcatgttcttcacatagtcggcgtgaccggggcagtccacgtgggcgtagtggcggttgctggtctcgtactcgacgtgggcggtcgagatggtgatgccacgggccttctcttccggcgccttgtcgatctggtcgtaggcggtgaaggtggcgccgccggtctcggccaggatcttggtgatcgccgcggtcagcgaggtcttgccatggtcaacgtgaccgatggtcccgatgttgcagtgaggcttgttgcgctcgaatttagccttggccatttttcaacccatccgatcgcggcacactgccgcatgtgtcaaccatggtctcggtcgatgcggcggcggggagtggagcgggtgaggggaatcgaacccccgtcatcagcttggaaggctgttgctctaccattgagctacacccgccagatcgtcccgctgggccgcaccgcctggtgctcgacctgaagaaaccgttccccgtcatccggcccgaaccggggcacccggccctcttggggaggataattggtggaggggggaggattcgaacctccgtactcataagagggcagatttacagtctgctgccattaaccgctcggccacccctccactccgtcatccggcttttcggccggggcgacgggagggctgtacttatgggaatttcacagagcttgtcaatccgaaaagagagggttaaatgccggggtaacaggagagccccatgaaaaagacagaagagcgcaaccgtccccacggccacggcaagggaaagcccccgcagcacccccgcggcagcggcggcggaggtggtggcggctcgtccatctggctctacggcatccacgcggtttgcgccgccctggccaatcccgaccgccgggcgcggcggctggtggccaccgtcgaggccgccaagtccctgcccgccaccaaggtgccggtggagaccatggagcggtccgagatcgaccgcctgctggcgcccggctcggtgcatcagggcgtggccctgctggtcgagcccctgcccgccaccaccatcgaagacgtcatccgcatggccgacggggccccctccgccctggtgctggtgctcgatcaggtcaccgacccccacaatgtcggcgccatcctgcgttcggcggcggccttcggcgccctggcggtggtggcccccgaccgtcacacccccgacgagaccggcaccctggccaagtcggcctcgggcgccctggagcgcatgccgctggtgcgggtcaccaatgtggtccgcaccctggaagacctgaagaaggccggcttctggaccgccggcctggccgccgacgcccccaagaccctggccgaggcgaacctgtcgggcaaggtggtgctggtgctgggcgccgagggcgaaggcatgcgccgcctgacccgcgagcattgcgaccatctggtccgcctgcccatgtgcggcgagatggagagcctcaacgtctccaatgccgccgccgtggcgctctatgagatgaggcgtggcgggtaatcacgatcgagccgagcgccctcgcccttgtcacctggccccggacggccattcggcacttgggcggcgcgatgccgttgccgcttgccggcgggcgtaaaaggggaacaggagcaacttcatcgtctgcgaaccggtccgcatggggtcggattgatccgatccccccttgcggccggcgaaattcacctctaatttcccaccccgcgcctgtgtggattggcaaacagggcgccagcctcgggttcggacgaactcgacacatggcgcattgatgttacatgatgaattgccgtgcaggcagtcttgttgcgtagagccggcttagctcagttggtagagcagtagttttgtaaacttcaggtcgcgggttcgaatcctgcagccggcaccacccctccccccttcgcgtacaagtgccccccatggttcggggaaaaacgggcagttcaccggcaattggacgcagagcgacgtgacgattgggcgtttgcggacccccgagggcgtgggaagcggcgcaatgcctcaagcgatcgagcatcgtcgtcaacgaacaggatgcggggcgtgccagccacggtcccagcattcccagatgctcgtcagccatccgacaacggccatgacctgttcccctgattgatcccagtcagaggtagagccccgtctccccgtgatgcccgaaatgggcggtgatggcaatgtgggccggggcatgccccggcccacattgcgctcgcgctcgtgcggcggcctgcgctggggcgatgccgcccaaggcggtgtagggccgcacatggttgtaatcttccttccagtccgccaggacggcccgagcatgattgatcgagccaaacagcgtctcgttgaggcattcatcgcgtagcttgccgttgaagctctcgacgaagccgttctgcatgggcttgcccggtgcgatgtaatgccattccacccggtgatcctggctccagcgcagcatggccttgctggtgaactcggtgccgttgtcgctgacgatcatccgcggcttgccgcgcccggcgatcagaccatccaactcccgggcgacacggacaccggacagcgaagtgtcggcgaccagcgccaagtactcacgggtaaaatcatccaccacggcaaagatgcggaacctgcggccgtcggtgaaggcgtcggacagaaaatccagcgaccagtgttggttcggcccctgcgggatcgccattggggcccggcaacccagggctcgcttgcggccacgccttgggcgcaccgccagcttctcctcgcggtacagccgcagcagcttcttacggttcatcaccacgccttccctggatagcaggatgcccagacgtcggaagccgaaccggcgacgctctgccgccagttcgcgcaatcgcgcccggatcggcgcgtcgtcgggacgacacgaccgataccgcatcactcgccgggaaatccccacaatcaaacacgcccgacgctcgctcagtccgaacaattctcggacatgggcgacgacgatccgcctggcggcgggcgtcaccatttttttgaggaaatttccttcagcacggcgttgtcgagcatggcttcggccagcagtttcttcagccgagcgttttcgtcctcaagcgcctttagccgcttggcctccgacacctccagcccgccgtacttggccttccatttgtagaaggttgcgctcgatatgccgtgcctgcggcacacatccgctgtcgcctgaccggcctcctgctccttcaggatgccgatgatctgctcctcgctgaaccggctacgcctcatcgttccgtctccttgatgggacggactctacctcaaactggctacattcgaggggaacaggtcaaggcggcttggccccgccagatggccccggtcgaatggatgggcggctcgcgggtcggggcggttgagcggctaggggatgagtgacaatgccgccacgatagccgaagatgcaaccagtggaggcggcatatagcgcaacctcccggctgtataatcgggggtgggcatgattgagtggctagtttcctggggacgcgccttcgtcatcttcggcgcactggcgatgattattactggcgttgtcgtcgggtggtatctcggtgcaatacttgatcgctacgcctgaaacatgatcaccgcgcctcgaatcatcggctccatagtcggcttcttgttcggctcaggcatcgccggaacggtctttggcgtcgtggccgcgatcttcgacattcaagagaacatccgcgccatcgcgcgcgctggcggccctggcgagaacctttccgcctatgcgccgcgccgccgcgaaccgacgttcgagagcaattgacggatacgcgatatgaacatcactcttcacatcgccgacgagattaacctcgtcgccatctatgccgcattggtttcaacggtcgtactggtctgggacatcatcaaatggtggcgtacagggccacgactgcacggtcacgcacgaggaggtatgagggtggctggtggcgtaggacaccacgacccctcatcgtatatcgttttcactgttaataatcgcggctcagcaaacgtcacgctaacgaacgttgggctgcttgcgtacccatcttggtgggcgaaatttcgccgcaagacgagtcactcattcttcgtaaagatcacgggtgagattggatgcgccattccctacgtcctgaaggctggcgagcagtttatgacgctagcccggcaagattccgagcttgaggcgctgacaagatcacatcaggtctacggcgcaatctatcacacgtacagcgacaagccgcttcttctgcggatagccccgatcctcgacgacaaaacgcagacttaaggcaccaacgagggcgctcacaaatgcgctcacaacgccgcttacattcgcagctaactcattgatttttgaggaagaaattcgcgtggcgtccccacgtggaggtgatgaacagcgacatcagcgccgcagatcgcttgatttcagccattccttgcgataaacgtgggtggaaaatgtgggtggaagaggttccccatgtatctcgtcaagcgtcggcggaagtggtgggcgcggcacgacctgcccgaagacttgaaagcgtacttcggagcatcgcgcctccaagaaggcttggacaccgaggatcgcaaggtagcagagaagcgggccgcgatcctgtgggtccaatggcagaacgaaatggagaaggcccgcaaggggtcggtggatcacatcgagcaggacgcccagttctggcggcggcgcttgctggacgctggcagcgaagccgagaaggaactgatccacgacctgattgccgatgaggccgagcggaagttccacgcccccgccattcgggccggtgtaaaggacgaccgcgatccgcgcttcgatgaccttgccgccgccgaagaggcgcaacggttcttcgacgtggcgactggccgggccgtcaagctggacgaacatctggacgaatggctcgccaccctcaacaacgaggccaagtccaaggacatgaagaagtcctccatccgcaagttcgcggaggagttccccctggtcgccgacgtgaagcgcaaggacgtgcaacggtgggtgaacaggcaggtggaagcgggcaaggccgtcgccaccatccgccggtccctgtcggagttgcgggggtattgggtctatctgaccgccctggaggtggtgtccgaaaacgacctccccttcgagaggctgaacctccccaagcccagcaagcgggatgcggtcctcaaggagcggcgacacttcgagcctgccgacgtggtcaagctggtgaacgccgccgaggagcgcggggatacccaacttgccgacctgatccgcctggggatgtggacgggtgcccgcctggaggagctatgcgcccttcgggtggaccgggtcggggatgggttcttctcggtagaggacgccaagacccccgccgggtggcgtaaggtgccgatccattccaagttggccccgaccatggcccgcctacttgaggtcagccagaaggccaaggacgaatacgtcttggcgggcctgtccctgaacaagtacggcgaccgatccaacgccatcggcaagcgattcggcaggctcaagaccgacctgggcttcggggaggcccacgtcttccactccatccgtcacaccgtcgcccaccagttcaagaacgccagggtggaggaagccattgccgccgacatcctgggccatgagcatgagcgcatcaccttcgggacgtatgcgtccgaacaggcgcggctgagcgatgaacaaatatactcttcgcaccgccgccggtctgccatttttggcaagcgtcagcgtgggtggaaaacgtgggtggaagcgccgagcagcaatccgctacgacgttgattttattgcattttttggagtggttttcgcttggcgtccccacggggaagaaagcttcattttcaataagttactgagttattgaaaataaatggtttttcggcacaaaatggtaaacacaaatggtaaacatgcccttgtgagggtgctatggcagtggtttggcggggatcatcctgtcgctttgtgatccgggtgccggaagaccttgtgaccaccttaggaaagcagatctctgagacccagaaagggctatcgcctgctattccaatgcgacggatcaaagatctcgagctgcagtggcgggcctcaaaaaaggagatgttcgagcaagttcgaactgcatccaacggctcgaactacatctctcggttggagattcgccaggctgccagggatgcggcattgcgcggcgttgggcattttcccgatcccatcacaaccagtggcctcggggttggtggaatagcgccactctcgccaacagttgggggacttcgcagcgaactggatgccatcgggacgacatccaagacttatgccgatggctggataaacgacaagggatgggtgttggcgaaggaggggtatgacttctttttgggctgcgtccggaacgcacttgaagatcggattgcctatgacctcatgaagcatctggggcacatagatgatcgtggaggcgatctggcgacgcaattaatgctgcatcctgctcgctccccaggtgaaaaatcgatccttaaccagaataaaattgatgatgctgagtggaatctcggccgccgtcgcctgacgttgatgcaggcaatcggtgagtttaagcagagaaatgactttgatcggttgcgctacacaaccaagatgacatttgaagatacatttgttgttttaaccgcaaagttcggggcgacccgtgaggttcacactattgtccccgaagatttttcagctctcggcgcagatttgccgaagctgccactctatatgaagcgaaagattaaagacggatataagcttgaagccttaaccaatgaaaatgatgagaaaattgcaaaggcaaccgtaaaccgtcatattagcaatattaagcagatatggaagtggctcgccgcccagcgcctgataaagcatgattcaactggtgaactcagaacaaccaagggggagcaaaagcacccgcgccaggttctgacttccgatgacataaagaatatttttattttgaaggctgaggagattcatggtggcgacatgaactcgatgaatttttggctgccttggatcgggctgtacacgggggcaagaaggggtgaaattgcccagctaacgccaaacgatatacgaatgtatgcaggcgttgagtgcttccacatcgaaacactcgaagacaatggcgcgatatcagaaaaaacaattaagacaaacgcatcaaagagagttgttcctgttcactcaaaactcattacgcttggcctacttgattttcgtgagcgagcaagagcgaatgagaatggcaagcttttctacgagttgacgtggaaccgaacccatagatggatgggaagagtcgaaaaatatttgtcgcgggtgctgcaccctgtaatgggcgggcgcgaatcggggaaaacatttcactcatttcggcataccgtcaacaatcggctactttggaaggccgaggtcgatcctggcatcgttgacgcgctgcttggctggtcgtcggaggaacgcaaggacgtcacggctgagatcaagaaagacctcatgcggatgcactatggcaaggccaccctggcgatagaccgtttgagggatggcatcgaaaaactcgtctttcccgagcttgattgacagctgaatgatgggggccatgacagtcaccgagatgatatcgcgatcaggaggactgcggctcccagccgatgtgaccatcgaagatattcttggccagatcacgctgcctttaccgtcccagatgccccccataccctctgggatttctggagtggtggcttcgataatcagaaccccttgccaggaaccgtgcctgcatgacgcggtttacgtcggctaccacctcatcccagcatccctgacagcaagtgttcggccgggttgcgacgtccacgaactgctctatctgctcgaggccgccacaccccatgtgccgataggtcggtgtttgtgctgtcatgcccctggccgggaaagcacaggagtagatttccaagatcttgcctaccgccaggagattgatcgccaatcccccgatgaaagctatgagcacctcggggtgtggtcgtcttttgtgggcgatgatcgttggaccatcctcggccttcattggagcataaaggggcgtacaggagtgatggtgcagtggtaaactgcgcccatggcccaccgctcgatctggtgttccaacttcgcgcccaggcgcaaggattcgcccatgccgaacgcatgcagcagatcaccggggccatcaccccgctgaccgccggaacacccgtagacaagacgattgggcagcacccgtcaccttggggtcaacaagaggcgaggctaatcgccacctcaatctgttgccattttcccgtaattgtgttagtgcccctaatgacaaaagaaatactgcccagagaatatggggcgaggggagagcatgaaaatcagacattgggcttgggtggccatcctaatctctgttcccatgcccgctcgcgcaacatctataagtgccgaagtatcttctcttctggatacacaccccagaattgcaagcgcgcgccacgagatgaatgcggcggcgcagcaggtcaaggaagcggtcggaaaatggttccccgatttggaactgaccgaagatgcagggcgcgagcggtatcatcgtgacgcgaccaagaatacggtggcttcgttccaccaactggatgtcaggctgacccagaaaatctgggacttcggcaaaaccaatgccgatatccgggccgccgaatatcgctggaaggcagccaaagagaactttcgcgccgccgagcacaccatcatctatgatgcagtgttgtcctacctcaacctgatgaaatcctaccgcatcctcgactactccaagaagtccgaggagaatatcaagcggcaagccaatctcgaatccgccatggtggtgtctgggcgtggctatcagaccgacgtgctccaggccaaggcacagttgtccggggcagaggcccgtcgggtacgggccgagggcgtgatcgatcaggcggtcagccattatcaggcagtattcctgcgcgatcccccagcagagtcgcagatggccctgccccgctctcccgatgaaaagctgtatcggtcacgagagcaggcgattgaagcggccttgcgccagaacccccaactggcctcggcccgcatgacctcccgctcggcgaaggaaacggcgctcagcgtcgccgccgacaaatataccccggtggtcaaggggatcgtcgagtcgacgcataagaacaatgtggctggattgatggggtaccagtccgaccaggtcgccaaagttcaaatctccttcccattcaatctcggcttcaccgccatgaactccgtctcggccgccgtcgagacccactccgcaacggttgccaaggaaggaaccgttcgcatcagtctggaggagcaggtcaaggggctattcaagaacctcgacgttcagaaaaagaatgccgggctgctccacaaccaggcgactctgtcagagcagttcctcgagatggcgcgggaagagcggaagatcaatcggcgctcgctgatcgatatccttcagggcgagacccagctctataacgccgaaagcgatgcctattccgccgatatcgacgtcatcatctccaccttcgcgctgttgcaggcaaccggcgacctgacatccgaccttctggaagaactgacgggagcgaatgccggtgcctcgattgctctcagagggagcgaagatgacgacacgtcgggcaaaaacgccaaaccggtggttcaggtcagggctatgaagccgccgcctcaaccccagccggttcagattgcggtgccggtgcctgctccagcccctctacctgtgagagaggtggttgccgccccgccggtctattccccgccgcctgctgttgagccggtggtcctgcgtccaccgaagggcatgggtcgacttgctccagctccctcccagaccagggcattggaagacgacggcttgacggactctgtggttctacgtccacccacagggcctaaaaagttgttcatccagtgaagccgggtaacgtccgatgaagaaggtctttgagttgctgctggccgaccggaagatcggccacttgctgctgatctccagcctgtcggcgaacatcctggcccttgcctcctccatcttcgtgatgcaggtgctggggcgctatgttagctatggcgtcgatgccaccctggcgaccctgaccatcggaaccctggtcgcaatcctgttcgagtatctgttccgccattaccggctcaagatcgcgcgatcgatctcaagcccgttggaacgctcgttgtcggagcagaccttcgagcgattggtgcgaacccggtacctcgccctggagaccctgaagcccggcatccgccaggaaattccccgcgcgccagaggtgatcgccaccacctataatcctgccaatctggttgcagttctggatgtccccttcgccttcctgtttctgctggtcatcctgctgttcaaccccatcctggccggggtgtcggtggtgttctgcggacttggcttctggctgggcaccgaggggccgaagcggtttgccgacgccatgaaggaagcgacagaggttgctgccagaaagaacgccgtcctggccagcgccaatagcgcctcggaaaccgtgcgggccttcgggtgtgctggatttctggccgaaggatggaaggaccgctccactgctgcccgaaagctgatgcgggccgtggaagagaacaagggggtgttgcagcatctgatccagggcctcggctcgatcatgagcgtcgccatcatcgccatcggcggcatcctggtcgtccacggcaaatacgacgtcagttcgctggtcggcgtcaatatcctggccagccgcgccttgggtgtcatcaatcggttcgcccaattgagcgaggccttggccaagggcggcaaatcccaggaactgctgaacgagttcggcaagcttggtcaggaagcctcgaccggtggtcgtgtggccgagtaccacggcaagatcgagttccgtgacttcgccttctcctacccacgctccacaggcccggtcctggaaggatttggggctatcctgaccccaggagaggccatgctggtgcaaggccccaatggatcgggcaagaccacctttgcccggctggtgatgggcatcctggaccccagccgagggcaactgttcgccgatggggtggatatccgccaactggctcccgactactggcgacggcaagtgatctacctcccccaggaggtcacccttctgaacatgagcatcgaggaaaacctgatgctggggcggaccgacctgaccaaggaggagatggcgacagctttgggtgtcgcccggttgaagaccttcatcaatcagcttcccgaaggcgtccgtaccgtcgtgaccgaacaggggcgcaacctttcacttggaattcgtcgccgtcttggtctggcgcgggctctgcttcagtcgcgggatgggcgtattgttctgttcgatgaacccaatgaagggctggatggcgaggggcgggcagccatagcagaagtgctgacccatttccgtaaggtgggtcgcaccatcatcgttgtcggagatacctctgaccttccgtttgtggccaatcacgtccttgatctcaccaccaaaccgactccgattctgcggtcatcgggcacgcctcggaatggaggcgtgtcatgaagttctccgatatcaagaccgaactgagacgcctgctggttctggatcagagtatgggcgaggatgatgttgatcctatcgcccgcctcatggtcatggccctgtcgggagccttggtagttttcattctctgggccagcatcgggcagttggaggtggtgtcggttgccactggtgaaatcgccccatccagccagctgaagcagctttcccatctggaaggaggtatcgtcggtgagattctggtggccgaaggcgatcaggtccgtgccggtcagcctctcctcacccttcaagccaccaagtcaacggcagaccttggggaattgtcccaacgactgctgtcgctgcggtttgaaatcctccgactggaggctgcatctgacagcaaatctgaaatccaattccccgccgatctgctcaaacagtatcccgatctcgccaaggaggctgatgccttcttccgcagccgccgcgcccgtctcgccagtgaactgtccggggccgatgagcagatcaagcagcgccaacaggaaatcaatggcttcagatcccgcatccagaatgatcgccatagcctggaattgttgaatgagcagatcgccatcagcgatgacctgttgaaaaaggatctccagaaccgctttgttcacatcgacttgctcaaacaggcgagtgagttgaaagggcgcatcaatgaggcggaatcggccctgagccgaagcaacgcggcactggccgaggcccatgcccaaaaggcaaaggtcacagcagccttcgaggaggaatcccgcactcagttggacaaggctcgccgagagttttcggagctctcacagcgcaccgcatccttttccgacaatctggaccgtaccgtgatcaatgccccggtcgggggtattgtgaagaagctctatttcgtgacccagggaggcgtgatccgccctggcgccccggtcatcgatctggtcccatccgatgaccggctgctggtcgaggccaagctgccgccgcagaatgtcggctacgtcaaggtgggcgaccccgcctatgtcaagctgacgtccccggatgcggccctatttgggcggttgcatgccaaggtgatccacatcagcccggacacctttaccgaagagaagatcggcaccttctataaggttcgcttgagcgtcgagcgggattttttcgacggcgggggagagcgataccaactcctccccggtgtccaggtggccgttgatatcgtgaccggaacacgctctgtgatgcgctacctgttcgggccgtatctgcgacagatgtcggaatccatgcgggagcggtaattgccggattgcgagcatcaagggtattgatggcgtttctgactcattataccctcacaatccttgtgtgatttctgccttgttgaaggggccaatccgtggctgatcaaattgcccaaaatgcagagcctgaaaaggctgaaggcaacgctgcgaaacagccggattcaggccaaggcaatcctcagccagcgcagggtgcagagggaaatcaatcagcacgccccggtgatgaaggttccgaaagttccggaacggctggaaaggcgggcaattccacaggtcaaccagcgggatcatcgacggcaactgaaacgcttggtgcgacagggggggcgtcacaggtgacccgaactcttacgccatcctccggcacctcacaaaacgaaccgtcatcctcgcttaatccagcctcgcaagtcgcccccccaggttctgcacctgtatcttcatcgttacagagcccgatgacgtcggcgtttggcagttctccgctcacgggttttggtggaacaacgaccgtcttctcgccatttcaatcgattggctctaaccaaatggcgccgacgggattcggtccttccgttggactcagcatgaatgctggcccgatgatgatgtcgcaaccgaccggtattggcgttaacgggttagggggaatgtcgctgagcagcggcactcagaccttcataaattttgacagttcgacgttcgggagtagattcgaatctagagttgaaaccgtcactaaggcctcaacaagtcaaaacacagactatattcagagaaatattattgcgactaatgataaatcgccaccgccatctgttcccgtccacataaatccaaccaatgactcgggcgacagttttgaaaagacaaaagtagaggccgatttaactgcgtattggcagaatataattgggagccatgccagcgtgttatccgctgtaagcgctggatacaacgcgtataaaacagaggtgatagagcttagtttatccataccactagtagacatgttgaccggaaaaaactcatcaataaaattaatggatatgagggtcctgtcgacagatgttcgttcagatatagaacggcgggttagcgaatcaattaagagcgacgacacagacgaaagaacaaattatgatttttatagcgagttaatgacacaagatgcaagggatgagagagctttacatgccccatatgctaatggcttttacagtctaagggcgccaggttctcctggggagacagtcgtttcattcagagaagccaaagaaactagcgaagttgcaactaaatattttgccttggcgaccgatagcgcatccagagttttagtttcggcgtggccagaattcaatcacgttggaacgcttggcctagctttactaacgtccaataactacaaaattgcaccggatgacgagaataatcccaatgatcagggggagctttggcaagatgctggaatggtcgttatagcaaaagaagttaattccggatcgtatgcgattagtatgggcgacagacctgcggattcagaattattaagagtagctgtgcatgacctgcgccccattgaacataatacctcagttcataatatggcaacatttatcaaggacgtatctatattaaactcagccatatatggcagcacatacaatgtatctggcgaccgatatcatgaatatatatcgaacaacgacaacaagaaatcaatcgctagcgagtcagagtatctaaatttaagcacaaactacagggaattcctcaattcatatggattcgacactctggatggcattgccttgggtatagcgacaggaaatggtgcgtcggatggatatccattttatgaatcaattttagaaggggcgccatctctttccattcaagagcacttcaattatttctctgccggagggatttataaaaacaatcaaatgcccctcccctcatcgagaaatcttgagggggattggtcgagatttgccggtgctattgcgatggtaaatttaaaagctgcggaaaatggtgaaaagactctatacctgaccttcagggggacagatggagatatcggcattgatggagaggctggaacatcagatggacagatacgctattatcgtcaattgatgccgataatagatatggttcgcaattacattgacaagaatgcagacattgcaaaccttgttgtgtccggacatagccttggaggcacaatggctgatttgttcacagtcattgattccggaagattttcgccgatagttaatctgagtgttgtggctattgcatcagctggaattgatacggaattcttttcaaaatggagggccatgggcggtgaatttaattccgctgttgtcaatattgacggcgccggagatctcactttatcaactcctggatattactattccatatcaaattcagaagattttgttggccgcccgtggaccataaattttgaaaaggtcggcataaagacagagggcggtaactccgtattgtggaataacgtgcacctgtctggcgcagacataattttaaaaaatcctgatattgatcagtatgaactggccaagctcaagggcaccggagagtattacgccgtaggatccacccatggcggaactttggttgagcgtaccatcccaacatatgaatctcttttctatgcacagcataacgaagagttatatgaaaaaaatatcctatctgtttttagcgcagcagaggctgcaaaattagattccatcgttggatggagtataatttgtggagatggaactgcgattaataccaacgatgtcgggagtggggcattacctggtgaatcatatatcgacagggcggacttgcatagttggggattgagtatcaatgacgatcttaatggcacgtctgatcgcgacctgattgtcggtaaggaaggtgatgatttcctggttggcaatagcggtggagatgttctgagcggtggggctggtgccgatacgtttgtttaccgctcaagctcagactcccatgccgacggcagttcttttgatataataacagactatgaaaagggcgtagataagattaatttttttggccaaaaactgacgcttattccatctgcgacttttgttggttcgggcacccaaggcatttcatcaacgatcgcaggcctagcagccaactcccccgatcaaaccgtgacatgttttacagatggaacggatggatacgtctatgtcaaggcaacgggaaccgcatttgacggcactttcatcaagctgattggccttaattcggaaatcggtgctaatgacatcgtgggggtgaaccacttgcccactctaacgaatgtgagcaagagcatttcagcatcgggcagttcagggcttctggcgaccgacttcacgtcgggcttttcagatccagacagtgacgccctctcagccatcaagatcgtctcactgccgcaattgggcggattggaactgaatgggcaatccgtgacagctgggcaggaaattgccgctgctgagatcagcggacttagctataccccgagtgagtcaggaaatgactcgtttatatggtcagcgagcgatggagttatgttttcagagcacagatctcaatttagcattgtcattgcaagcaatgcaaagccaacaataaccgacattagtgaaaaatcattttccggattgtactggtttaattcacatcagtttatcaacgcttactcagatactgatggtgattctctatataaaattaaaattgttgagttgccatctgaaggttttctggactttttagggcaatctgtttttcctggacaggaaattcttttatcagaaatttcaaaaatgaattacttcccccctgggggggggggatttaatggagtgcaaagctttaaatgggccgctactgacggagatgggcatgaattttctgtgccgcatgactttatcttgcatttttcttcattatacactccgatgacgcaacagtcgtatgggtggggatacccttatagcgttacaactccggacgtcgccgtttccgagcacggagagcgctctttggtcacttacgtaattaatgttagcccattcgtccagccatacctttgtgcggaaataagagggtacggccaggatggaaatgagtacgacgtcaaaaacttcataacagttaacgatagaaattttaacaccgatagttttggatttgtcaaatcacttcacgttacagatgccgtcaatagtagatttattgtgtcatgggcgcaggaatcatattacgctcgaatgatagctaactatagctatgtagatggtgtagatgttagagatgttggcatgagctttccattatttagggttattgatggagagggtaattttattacggacccaattgttgtgcggcaacagcataatttaagtatcgatgttgcgtcactttacacaagtggctccctcgagttatctgataaattcgtcgttgttacagatagtgccggatttttatctgactatcattatgcttctggggcaattaatagcggtgtgcaggcgaagatctatagtatggaagggatgtcatctggaggtgatatttttatctctaatggccatgacgttcaggtgcaagcctctatgcaaggtggtttttatattggatacacagaagttaatgaattgcaaaaaacagatctgtatataaataagtatgattcagtcggctccatgataaaatcgactaaaattgcatcagaatatggccttcattatgatatatcttcattatcagaaggtttttcagtcgcttgggacggaagcgatacagtgtcaggctcaaaacatgttggcatagcgcgatacaatggcgatggcattgaagtttataattacaccttatctgacaatgccagcaatgctcgaatttctgatattaatcagaactggagtgctgtttcatattttagcaataatggaatcatgaatatattttatatagacagcagggggacgcaagccgcccattggaattggaattccttgcaagctgttggaatggactttgaaatggatacttttatggacggatctttattaatgactcagaagtttgatcaaggatcaaaccactatgcgcttgctcgacatttttctccacggctctgctcatcagaccctatcgtgtttgacattaataatgattcatcatttttaaataacataaatatagatggcgttttattcgatatcttgtcaaatggggaagtttcacacattaactggttctcacccaacgacgctgtccttgctatcgactctgatcgcaacggccaaattcaggggatgggagagctcttcgccgacttgtccggtaagctcaccagcacggaggttctcgcgacattcgacctgaaccacgatgagcgtatcgacgacaaagattatgtgttccgtgatctgatcgtctggagcgaccgcaacagcaacggcatcagtgaagccgatgagatgaggtccatccatgacgcggggatcatctctatcgatcttcatacgaccccgagcgacgttgacccggcaatcctgtcacatgggacagccaccatggccgatggcagttccctgaacttcgccgaggtgatcttccaggaaatgccacaggtcactgatcatcatgtttgaagtttgggctttgtaatcccatcgcctcgaccttgccgccgttcagggcaaggaatgcctcggcgtagtcgtttccggctttgaaaacccggccgacctcacgcaggaagcggtcgagcgaggcgggttctccacgccaagccgccgtcatgaccttgcgcaactccactccgttgccgctttccaccagggcgacggcaagacgccacagcgggagtggcacgccgtcgcgcaaggtgttgggcgggccatcccaactggccgccagccctccggcatcggtacaggtcagacgtgacgaccggcagatttcggcgacgacggcactgatcgggcggcgcaggccatccagctttgggcgcagcccagttcccggcacgtaggccagcggcaccagggacacgaaagcggcgtaggggtaatcctcctcgccccccagggagcgcggcacataggtcgatgacgtcagaaattccggactgccgtcgccgtccacatccctgaccgtgtcggcacagggatgccaggacggataggcgtgggtctccagccgcttgcccggtaccaccagggtgcaggtattgggcacccgccctcgaatgtcagcggattggatcagcacggcgccttcggtgatgcgtggcagcgtccgggcgagcgtgcattccgtttcattgcggtcgccgtccgtggggatgcaggaccacaggcgcttgacatccttgcggatctccagaaggacgccggaaaccgggcgcaagctatagccgccgcctagttggcgcgtctctgccgccagagccgatgcactccaaagcatgccagcgatcaagccgatggcggcaatgcccttgcgcgtcatgattatggatccttggatatcaggggaagcaacatcgatcatcctcttttgttcagcgggtcaccccgagaagaaaatggccgcgccgagggccagaagcggggagcagatcaacatgagaatagcaatgacccatgcaatggatggcccatgcagatcgccctgggtcatcgtcggcccggatggggtcagggccgcgatgaactcccgcaaggttccgcagacatagccgtcaggatcagccagatcatcggtgaaaaaaatctcacgctctgtctggagggcatggcatgcggcaaggcgaaattcctcccaagtctcaccttggctcacggagatgattttgtccgcgacctcactggccaacttcacggatttccatgggctgccatggcgctcctggacgtaataggctgaggcgtaggtctccttcagccgatgggcaacggcagcgacagcccccgaggcccgcatgcgccatgtccagacatcatcccggcttgccattgcgtttggttctccctgacctctcgctgatcgttggaggtgtagacggacggcttccgagtattgcttgttttttcttgcggataaaccctcgcgcctgtccgtctattcctgaaattcgggtatcatccccggcaccaaggaggggagaatcaaaatgacatcagcaccagccgaggccgacctcgacctcatcacccaggccccgaccagggaaacggcacgcgacctttgcctgctgatcaatgatttgtgccacctggacaaaatgcggcagatcgtcgtcctggaagacacgctggatcaccccgagcgcagcctgctgttctacgcttatcgtcaggtacgggatcgctcttggctggcggaaccgatgcgcgacatcttccgccacatcaccttgggcctgaccgagcaggtccaggtcgagcgcctgctcgattcccgcatcgcggccatggccgaggaggaccgccgtcacatccgcgacacccttgccggaatggctgacaagtcggcgcgggaagatctacgcgagcggctgaacgatgccgccgcagataaggtgctggtgctgcgggccttgcgcaacgccctggtagcccatgtgggtggctacgcccccatggtcgcggccgattatgcccgtttctcgctgccggactccttgcggatggactacgacgagcttatcgaactcatcgccaactcggtgcgcatccgcgtgggaggcgcggccgaactgatcctccccatcgatcccatcgatcccgccagttacgattatgaccgacgcatggctcgccgtctcagggaggataaggaagaggttgaagaggcggttgagccggttcccgacctggaggccaggttggacgccatcgcccagggttgggccaatgacgatcccgactggtgccagtgggttgaccgattggcgggatatctccagctcatccgcgaacgctcgctgaagaaattgacgcggctggttgatgaaggaagctgggccatcagcctgctggggttgccgacgccggtggtcagccgaatcttcggcttgatgagcaacggtgcccaggcgtcactcctccgggatatggagaatcattgcgattttgatggcatttgcctgacccgtggctatgtgtccaggacgcggcagaacatccttcaggtcatcgagcagaaggggctggccgatggcggcgcggcacggctgaagacgatcatgcatgcgcctctgggctacgaggcgttcgatgccttggcgacgctggacgacggcgagttgaatgcgctgtggcgccagaccagcaaggatacggtcgggaccgcgttactgggaacttctatcgaggttgccgtacgcctcctcggccgcctgagcgaggacgcccgccagatgatgctggacgatatggagagcctatccgccgagaagacaacggctgacatcgaagaggctcaaaggaacatcctttggcccacgtcatgggatgatgacgcgacactggatgagacgctggctagcctccgggcaattttggcaggatcggcgtcgtgagtgggattgcttctatccgctcattgatccgcgaggccccgacgcgggaagccgccctggccttgctgctgtgcctctacgacctttggtccttggccaaggccagagggccgctggctttggaagaccacgtcgttcatcccgaacggagcgtcatcctccaccaacatcgattactgtcccgactgccctggttgatggaaccgctgatggatctggtgcgccacttcaccctgggaaccgatggcagctctgcatacgatcaaatgatcgatggcatcatagccgcggaagagcagtggatgcgcaccgtccacggtttggtgatgctgctcgcctcggtaatagccgtattctgggttattgccatggtcattgtaagaccgcctctggtcatggaaggaagcctttcctggcccacggtcacgctctggatcgtccccatgggactgaccatgctggcacttcattgcatcaaggtttggatcggatgggttgcgagtgagcggaccggcatgctggaggcactgcgccgggggatatgctttcacgccgatggcgcatttgccccccaggtgagcgcggatgccgctcgcatggcgttgccacagcggctgcggccgagccatgaccagttggaaaatatgatccgggcggaatccgttcggtacctctatcccgtcgcccccctgctgttgccagcggatagggccgacggaaaagactgcgccacggccatccaggacatgttggaccggttaatgccatccgagctcgacagtttcgagcgagatcagaggttgaatgaactgctgaccgatctttccgacgatgtgcctcccgagtattccgcggtgtccgtggacttcaaccggttgtccctccttggaacagatggcatccgagtcttgctgcattccattggcaaggacatgtgggccatggcgttgcgcggagccacctcacatacggctcggtccatccttgactgtatcagccatcgcgccgggcgattgttgatgcaggacatggaggcgctggacggcgctacggtggtggagattcttgaggcccagcgcacgatcatcgagacgctcagaaacttacgtgcgacagggactttgccggatcaggcgaccttggacagggagtttctcgcgcagctctcgtctctggacagccccctatcctgacgcaaaatatcgcaatggccttcatggcgggagcattcgcgtgacgatattttcatccgcaatccagtcagttcgtgcgctgcgccgcgaggccccgacgcgggaagccgccctggccctgctgctatgcctctacgatctgtgggtgttggccaaggtcaagggcgatctgtacctggaagcccatgcggagatgccgctctccagctccctatttttccaccacaagcccatgcgcgatctgccctggctgctgacgccgctggtggatttcattcggctgatgaccctgggctcgaataatgccaagcaggctcggcgtttgttgcaggcctaccgagaaaccgaaaagcgtgctctggaccatgttctgcggcaggcatcactcgtctggccgatggggttttgcctgtggattgccggtctggcggtgctggcgagtcttggcggattaggcctgacggcattggcttggtggggtgtgtcgctggctgctgccggagtgatggtcgggatatggctggtccgccttcgcaccatcgcggatcatcgccttggcgttctcgacgccatgaccgagggatgcctgtcctatctgaacggctacgcacagcagatctgcgccgagaatgccagattcgtcctgccgccagccttgaagccgagcttcttcgaactggctgacgcctttggcgaggacagctatttccaccgctacggtgcttataacggcttcaccctgagtgaaaccggcacccaggcggagatcgacaccaaactggccgagcggttgcaggccatcctggactatgaccccgactggctggccaaggcattgcccggcctgtcccgcgacatcaccggggaacttcccgccgatcaggtggaaacggtatcggccttctctcaattggccgatctcgacgaagccagcttgcggatcatcctgcagtcttgcgcccatgatctgcgcgccgccgccctcataggaacttcatcggccgtgttggagcgtttcgtcgccaatctgagtgaagccgaccagaagacgctggtgacggacatccgggccatgggctccatccccgccgctgatatcgccatcgcccaacgcagcgtgctggatctggccaaatccctgaccgattcaggggagctggccgccaggaccaaggaagagggggacctgctgacgctgtggaagcggatgagtggagaggaaggcgcatcggggcagcctggtcgaccggagaattgatgatgccctctccgcactcgctgttcgtccgcttccatcgcatctacggtggctttggagcaatcgcgttccgggtctgcctggtgatcactttccctttttctctgggattgattgccaatgtctcgagggatggtttctggcctctggcgatctttgccgttttgtttatcaccggttggaagattttcgtcagtccgccccagagcatcctgatttcggccgagcaatttcctccgccaaacggacggcctggaattcttccccccgatcgcccccgtgatgaatggcagtcccatcacttcatgattgccttcctgttcaagttggccctggtggggacatggatttcgctgccgttctggattacctgggccatctggcacgaccctcagatgaaggaaggggccgggttcgggatgatcttctttccctttgccggaggactgatcgagggaacgttgcggggacatacccgaaccttgaaaaccgcgattgcgtctacctatttggcccctgccaaggacagcttggcaaggccattggcggaggctctccccgcctccccgaaggcatcattgccatggccaccgctggttaccaccgttttggcccttcccttgacagttcaagccgggcttgtcgccaagcaattagggagccacacggactcgcccttcctggtgggaacggcggtgatctcggccttcgtcctgggcttgtggtgcgcctggacggcccatggccgtcgagatctggtcaaactggcgggggatgcggcattcctcggagtgacggctcttgtcctcatcatgataggagcgattaccgggaccatggtcggaggcgctctgagcaaactgttcggccatatcggcgtgcaagtcggccttctcggtggtgcaatcggcggccactttacggtgtcgtactggatgatgggggagtggcggcgagggccatcgttcggaagccgatccggctcgatcaatgggccaggctggattcttcaagcctggcagccggatgccgaggtcctgtgtccggtttccatgcccgatggggtgtttttcacgcctccccctaaagcggtcggcccagtggtggcggcgtggacgtcgatgcgatcggatgtaatgccgctttctccgctgatgcgccgcatccatgtcctgtccatgaccatgttgtttgctgtcaccgcttggctggccgcatcggggatgcaattgccgccagttgaacagcccgcatggggatttgttggcgcgatctacggtgcagcactgggctgggtgctgacaagcttcaccgaaacctgccgattcgtcggtcgagacggttttgcctgtgccagcttcgagggggcgcctccaatgatcaccatcagcagcgcactggcattttccgaggcacacgcgttgtattcagagcagatacagatgacctcacaagatattgggggcatggtgaccggcgccgaaacctacagttatctgtggtgtgacaatcaagggcgaaagctgtttcagcttgatggaaaattccatcaacgtaaccccagggaaaagtccagagcggaactggataggttagctgcgtggcaatggaccgccttctgcctcgaccgctaccgcttggccctgcataccggctcaactctttatttcgaggcaggggggacgcgaattgccatcacggcaaataccgcaacggtggttatcggtgaggaacgccacccaattcacgaatacaccatcgataatggcgttttgtacctgactgtcgaggatgaggcgaaggatcgagcaatgcaaggagcgcgaattggcaatttcagttgcctgctgatcctgttggccgaacggatacgtccttctcaccaaatttcgggatagatcgaatggctcattctcaaatatcctcaccgattctgccctggtcccaggatatttacctcgatgccctggtcttcgccgccgaacggcatggcgaccagaagacgcccgccggcttcccctatgtcacccacctagcctcggtggcccaggaggtgatggcggccctggccgtggagcccggacgcaatggcaccctggcggtgacggcggccctgctccatgatgtgatcgaggataccgccaccagcctcgagatggtggcggagcgattcggtcccgatgttctggcggcggtcatggccttgaccaagaattccgaccttcccaaggaacggcgcatgcccgacagcctggagcgtatccaggctcagccacctgaggtctggatggtcaagctggctgatcgcatcgtcaatctcggcccgccgcccacccactggactcgggaaaagatggcggcctaccgggccgaggcggagaccatcctgtccgccctgcgcgacgccagcccgtttctcacccaccggctggaacggcgcatcgccgaatacaggttccatttgaaatgagccccatcttgtcgccaccaccgtatctatgacgattttggtgctgcaagggtacacgagtttggcaaccacatgctacgcgaggacaacggtttcgtcgtcaagttcaggatcaagactgggcgaactggtttctcgatcaccaaccaccatttgaccgctgctcctccggcgatggagcgcgtcatcattattggcaagggcaaactcgggggtagctggaggcgctgacgtgatgattcgatgttttttccgactgcttgccgcatttgttttcttcacgacatcaccagccttggcagaatcctggcaggaggccctttctcgtgcaaatgatttgggacgccaaggaatagcagcgcatcgtgcgggaaagctggacaaggcggaacaattgctccgctcggccatagcggcaattccagccgataccccaccaaatgaaagcgatcgggttggtatattcctgcgcgaaaagatggccgagttaatgtcaacccgaggaaagccggaagaagcgcgtcaatggttggatcaggctaaacgcttttccaggggagacccatactcgaaaggtcatctactaaatgaccagggactactggcgtatcatcagggaaaattagatgacgccgaggaattttataagcaggcgctatctatatttgagaaaaatagatggaattttgatcgcgcaatgacccttggaaaccttgggttagtttatctcgatcgctacacaaggagcgataatatcgaccatgtccaacttaataatgcagagaaggctttcgctgaatcacttgatgtgatgctcaaatatggcagtaaagttgatattgcaaatcaatggagtaaccttggaatagtctatcgaaatcagaataagcttattcaggccgagaatgcgcatcaagaaggattgaaaattgaccgagaaatcggcaataaggtgggtgaggtcgattcgctcgggaatcttgggcgcgtcgccaaggctctgggaaagagcaatgaggcgctcactctattccatgaggcatatgatctggcctcggacattcattacgctcggggcattagccaccacgggcttaacgcaatggctctcctcaatgaccgaggattgtatcgaatggcggaggcgtatggtgagccaaccctggctgcggccaagggcattggccataatttcaccatcgccagaatccttgaggaaatgacgaccattgcggcaaaaggtcatgggtgcttagccgcggccagagaattggcacatgaatcacaaggctatttcgaggctgccgatttggtagaagactcacaacggttaaaacgccttctgagggacatttccgccgctaaaaatcaaccctggtgcaaatgaacttacatcttagcaatttattattgagacgcaagattcggcagtattcctgactttaatggcaaaaaactcgcccccactcctccttcttccggtcggcaattaccttgtacctgccggaattaccggagagggttggacacccgttccctttcctacgccagcgatttcaaagacttaaggtcaccttcgggtggcatttgtcgattcgttcggaaaatatacggataacatgaagcggaagcgggcggatgtaggtggacacccgtcaacgcacaaagagcgctacgcggcaagccgtcccctcatgaatcacgcaaacctcctcttgggaacccgaaaatgcgcgtccacaactgaaatatgacaaagatgtgctttaaaatacgtataacgggtaacaagattggatgccaatttcaattggcccggtaataggctgttgaagttggaaccgtgaaatccctgatagctgtccgaccggtgctcggatccaccatcaccacccgtttgatctcgacgtttcgctggcgtaggcggccaaacagatggcctgcctggacgacgatttctgaattgatgaatttagcacagactgggccgaagccgtcgcgaagcggcagatagataaccgcgcttccacggaactttactccctggaacttcccgtcaccatcgccggtcaactgaaacactgcgtcctcaatcttctttccgccgacggtaatgattggatccgtgtccggaccgtcgatctttttgacgcatccggaggcgtggaaatagatgacaaacgctccatatgtgtgttgatgtaaatctttttctctcatgataaatatttatacaaaatataaacgcaggagacacaatgagacaaaatgactttgatgaatcttataatgacttcatccatccttctgagggtatagatgttggcaatgccaatgatcagcacccaactttgatgtacgacgtcaacaaggcatttgacgcgatgcgccagtgcctggcgcgggtcgaacgattgatcgaccaaacggagcagaagctggccgattcgcaacttcccgtcggaatcagggttgtcgagcggtagctggcatatcgccagttaggctggaaaggcctaggcgtggtatttcaagttgctgtcgatcttgaccagagatgtatgtgccatacatcacgtattatccacagcaattatgtatatcactctcagagcgcgacctggaatggagatatgcattatggcattatcgcctcatggccccattaaccacggaaacaacatgtttcttacccatactcatcttttataaccgaagaatattgctaaaattacattgatttcggaaaattgacgttcttgcggtgacggcggtatcaccgatacaggcttcaaaatctgaatcgggatacggctatggccaagagcaccaagaaagagacatcagaaaagatcttcggactgatgttttcctccaacgaatatgaacatgctgaggcatcacgtaaattggttgaacactttcagcggaataacgtgcatccggacgacgtccacctggtcgtctacggcgacgaagacgattttgtcgccagcatgttgcagaaggccgatcgagaaatcgatgaatgcctcgctgatatcgaggggtatcaggatgagatcgcccgcctccgagacgaggtcaaagacctcaaggcgtcagttgccgccaaagatcggcggctcgccaagcagcaggccgagatggtcaagcaaaaggccgaaatcacagggttgcggagcgaagtcgatagcctatctgtgaagcggccgacgccaatgggctccgccatggacgccagtgatcgggctgaattggagtcctaccgcctcgaagatggcgtcaacacggctgccgctaaaagggagctgcgaggatgtatgaaaatctgttccggttggaaagctaccctgtggaatcttctgaaccatcgaggcttggcgcggtcgaaggccacggtatatcggtggctggcggggcgctctaagatgcctgcccaggttttggatatcattcgggccgaagcccgacgtctggctgggctggggattgccctcgggtcggccgaatggtggcagggggagctaaccgattcggagcccaatctgaaggcggcctgattggtcacattttcacaacggcgattgcgatggcaaggatcgcaaacatcgccatcatcaccagccgatttcggcgggcgcgctgctgctgaatgcgggatggcctgggtcgcaagatcgtcatgggtctatgttcgaacacccatagctcggcgtcaatgtgagtggccaaggccatcggattttgattgttcctggatctcgatccagatttccgatcgcattctggtgatctcgtccagcccacctcggagggcatcgacctctccctgatccgtggtcgctacaatttcctcctcggtcgccctggctatcttttccaactgcaggacgaacgcgacaagggctgcagtcgtaggccgacgtcctctggccaatgtcgagctgcaccatgacgcctgtcggccaaatagtcggctaaacgacctctggtcagagacaacccccagatcacggcattcgttgtaaaggtctcgcaaatcccgcatcacattcctcctcggctgcgtgtgcaggtatttatctattggcgtcactgatgaattccgcagaacagcggcatcgcaaaaacgttcgtttttgacataatatttttgccttggtcttttgcaggattaacggtggtgttattatctcaaaactgtctctcaaaacctgcatatcaattcatgttcatatagatgagtattgagaaggagcgagctatgcttgttggttacgctagagtgtcgaccttggatcagtcaccgcagctgcagttggatgcccttggtggtgttggttgcgaacgaatcttttccgaacatgcgtccggcgcccacgccgaccgccccgaactgaaggccgccctgggcttcgctcgcaacggcgatacggtggtggtgtggaagctggatcggttggctcgatcgacacggcagctgatcgagacggtcgatatgctcaacgagcgtgggatcggtttgcggtcgttgaccgaagcgatcgacaccaccaccgccggggggaaattgatttttcatattttcgccgccttgggcgaatttgagagaagcttgatcattgagcggacacgagccggattggactcggcccgcaagatgggccggatgggcgggcggcctcggtccctgtcggaccaggatgtggaggtggcgcgagccatgctggcttccccggtgattactgtcgaggaagtggcccggcgcctcaatgtgtcgacggccactttgtatcgccacctccctggtggacgtggtggtggcctggatcttcgacctgcgggctgatgtggtggctgtgctcgcggattaggctggtgcccaggtagccggttacggcctcactaagtaaatgcccaatccatttacttagtgattactaagtgcaagctgttgatttataatgataatttagaatttagtaactaagtaaactaagtaagagaaaaaccatttatagaaatgaaaaatattattttctgttttatgcggagctcttgaatctacctacttagtttacttagtagccatggagttccgcggaaatggcggaattgctggggtttgcggagcttccaactaagtaagagctccgccaccacgtcagctataccggggctggtcatctatgttggcgatttgtggtcgtcgcatcctgaggcgttgctctcctagccaaagggccgtttccagtccgaccgatctcggtcgaagggataagcggcgctcgaatctgcttggactcagcgatgacctgccccccttccactgatcgggatcaatcatgaaaacaggtcagtggcggcctaccgagactccactcttcgctcccgccagatagttcaagacggtttgaaccgcgagcgacctgtagcgttgagggctgctgacaatccaggcatcagcctgttccattggatattccggcagcaggtggatcaaggtgcccaggtccaggtccgtttcaagcatgaagtcgggcagaagcgcgatcccatggtgaaggcgtgcaagttgatgggcgaccagcatattgccggcagcaatggtccatctcatcgagcactcccaacccccatcaaagcgccaactatcgagggccgcgctgatgacgatcgcgttgtgcgaggcaaggtccgagggggccaccggtaccccggcctttgccaggtaggcgggggatgccacaagcaggcgcttgaccttgcaaagacggcgagcgaccaagtcactgtcatcaagtgtgcccgtccgtactgcaaggtcgatgccgtcgctgatgatgttgacgcgccgttcagtcagcctcagttcgacctgcacatccggatatgctgccgtcagcttgatcagatgcggggtaatcagatactgcccaagcgccgccgtggtggtcagcgatactcggcccgcgacaagccgttcgcgctcggcgattgcccgtgcggcatcgtcggcggcggtgatcgacggctttgccatgtcatagatgcgctgcccctcatccgtcagcgatagggctcgcgttgaacgctggaacagcgatgtgcgtaaaagcagctcaagatcggcaagccttcggcttacggtagattttggcaggccgagtgtcttggccgcagctgtgaagctgccttcatcggcaatggtcacgagcagcgcaagatcgtcgagcgatggcttcattgttctgaaaatggaacagtaccgtccaaacttcaagccttatgtggacagtgattaaggcgcatatggatatcaacacagtcagaggactatgccatgatccgttttacgtctgtctacaccccgacgcagatgcgccatggcgcggtatttgcggcccgccagtatcctcgccaggcgtttggcaaccttatcgatccggtcatcaacattgactggttcgaaatgaatgccccaacctttccgcctcacccccatgcgggtttctccgccgtcacctatctgttcgccgattcacccaatgggttcatcaatcgcgacagtctgggcgacgtacagaccattcaccctggtggcctgcattggagccgagcgtcacgcgggttgatgcatgaagaattcccggttcccgaagcaggtctcgtgcatgggctgcagattttcatcaacctgccggcggccagccaggccgatcccgccgcagccttttcggtcccggccgccatggtcaaaagcctttccggcaaaggctgggaaagccgtgtcgcggtcgatggaacgacggtgggtgaaatcgccggagccctgccgtcaccggtccggatcgaggaaatctcgctggccccatcggcgatgcgtgacatcgacatacctgcgggttgggggggcattgtcgttgtgctcgagggagacgtttcgatcggtgacgtgacccttgccgccacgcaggctattggctttgccaccgacgtcgaagggccgttccggatcgccacaggggccggccaagcccgcattgcggtggtttcgggggcgcagctcaatcagccgatctatgcccaaggcccgctcatgcttgccagccacgaggccctcgaagaggcgcgtcgccgcgtcgcctcgctcagcttgcccgcctgacccctgccacatgttatccacacaaaggaatcacatcatgacgaaacgcttttctgctgaaaatgccgcgcttctgctgatcgaccatcaggtcggcaccatgcagctgatcaagaatatcgaccgcaatcttgccgccaagcagtcgatcgccctggccaagatggcgaaaatcctgaacatgccggtggtgatcacctccagccaggaagatcacgcccaaggccccattctccccggaatcgccgaaatcctgccggaagcgcatgcggcacgggtcaagcgtcccggcgtggtcaacgcatgggcctatgccgacttccgcaatgcggtgctggccaccgggcgcaagaacctgatcatggcgggcgtcaccaccgatgtttgcctgatcttcccggctattgatgccgcactcgaaggctttgccgtacaggccgtgatggatgcttcgggctcgcccagcgatctttcggaagagttctcacgccagcggatgcacgacgcaggtgtcgtcctgaccgccactaatacgctgatggcggaaattgcccaggactggtccacgcccgccgggcagcagctgatcaccctgttgttcaccgatgtcttcccggccctgggtgccggcatcgtctaggtcagaaatcaatcgcagatcacgaatacggagcccccatcatgaccaaagatctcttccagcccctgcgcttgggcgaacttaccctgccgagccgcatcgccatggcccccatgacccgctcgcgggccgatgacgagggcgtgcagcccgagatcgccgccacctattacggccagcgcgccggagctggcctgatcatctccgagggcatctacccgtcggccatgggcaagggctatgtccgtactccgggccttcacaccgacgcccaggtggcggcctggagccgggtcaccaaggcggtgcacgacaagggcgggcgcatcttcgcccagctgatgcacaccggccgggtggccgttcccgccttcctgcccggtggtgcgctgcccgtggcgccctcggccatccgggccgaggggcaggcctacaccgatcagggtatggtgccgatggtcacaccgcgcgccttggagacctcggaaattgccggtgtgatcgccgaataccgagacgccacccgccgcgctctggaggccggcttcgacggcgtcgaactgcacgcggcatcgggatacctaccggaacagttcctgtcgtccaagagcaatcaacgtaccgatggctatggcggctccatcgctaaccgcgttcgctttgtggtcgaggtgctggaggccatggcctcggtggcgggctcttgccgcgtcggcatcaagatctcgccggagatgaatttcaacgacgtggcggacgataccccgcaggagacctaccgccatctggtggagcgcatcgcgcccatgaacatcgcctatctgcacgtggcgctgttcggcaccccgaccgattatcatggcctgctgcgccccctgttcaagggagcctatctggccggcggcggctttaccggtgacaccgccgaggccgccctggcccagggccgcgccgatgccatcgtctttggtgccgccttcatcgccaaccccgatctgcccaagcggctggcggaggggttgcccctggccgaacccgacaaggtgactttctacgcaccgggaccgcggggctacatcgattacccaccggtggtatgacggagttgggatgaagaccgccggcgactgtggtgtggatatctaaaagaggcggccggccaggacatccccctggccggccgagtttcgtcttggcaattgctctggttgccgccgtgtcagcctccttcggacacacgcaccctacgagttcagagaatccaatatagtgggcgtggtggcgggtcatctggggtggcgatttgtggtcgtcgcatcccgatgcatcgcctcctcaccaaaccgcaaaatcacaaataacagccagcattgtcttcggcaattcttaattatttctttgaaagccacggtcatatctcgaaacaacccgatgtgctgcataattatatggaaaatacatgattttataaagacaaaaagtaaattgcggaatatgggtcatcaggccgatattgacatgacacaaggcaattccgccaagtgaccgccgcaaatatgagacgtaattgactgtatcacgttgatgatggtggattattcagagggtattagattatgggtatggatgttgacggggagaaccccacgtcagaacgcggagagtattttcgcaacaacatatggtggtggcatccactgtgggatttttgcgagtacattgctccagacctaattcctagaacaaacctgggccatacaaacgatggctggggactcaatgcgagagattcaatcagccttgccgatagaattgatcaggcaatcgccgatggaacggcaaaagaattcggcgatcgggtcaacgcaagttcaagtatgcatcactgcggcttcgccatagataacgcccaggaattctctgagtttctgcgatcatgcggtggatttgcaatttggtaatgccattgcgtgagtaaattaacaatcaactaggtccggcgcccaggagacgtcggacctgaaattttaggagataccctggcattcggtagccactgccatcttctgcttgggggggggcggaaagggccggaagcggaagggcggcaatcggacttggaacagggacagcggtcggtttcgccgaacacgatcccgccgttcatgacctaacccgaaaactcgatacagttaaatcatgaagaaagggccacccattttcatgggcagcccttagtttgacccgaaccagggtcagtgcggcgggaggagccgcaaatttcattgcgtttggtcagagtgaagccctgggcacgcgcacgatgcgcaacaggttggttgaaccggcagttccgaatggcatgcctgcgatgatcaccagtggcttgccgccctcggtgaaaccctctctggtggcgatgcctgacgccttggcgaccatgtcctccacattggcggcatcttcggtgtggacggaatggacgccccaagccaaagcaacgtggcgcgcagtggccgcattcggggtcaagctgaggatcggggaagccggacgctctcgggcgatgcgcagcgtggtgaatcccgaagtggtgtaggcgacgatggcggcgacagacaggatgccggtcacctggcagacggccgcgctgatggcgtcggcgtcgttggcctctggcttggcgcaaccgctgcccagaccgtcgagatagttgggatcgctctcaacccggctgatgatgcggctcatcatggtgacggcttcgacgggatagcggcccgaggcggattccgccgagagcatcaccgcgtcggcaccggcgaagacggcggtggccacgtcggaggcttcggcccgcgtcggtgtgggcgcctctatcatggattccaacatctgggtggcaacgaccaccggcttaccggcagcgcgacatgagcggatgatgcgtttttgcaggccgggcacatcctcgggcggcaattcgacgcccagatcgccgcgcgccaccatcaccgcgtcggacagagcaacgatctcatcgaggcggtcgatggcggagggcttctccaacttggacagaatgcgggcgcggtcgccgatcagggcgcgggcctcctccacatcctcgggccgttgcacgaaggacagggcgatccagtcgatgcccaattccagggcgaaggcaaggtcgcggcggtccttctcggtcagggccgacagggggatcaccgcgtcgggcacattgacgcccttgcggtcggacaagggacccgccaccaccaccacggtttcggcaaagtctggcccgcaggattcgacccgcagccgaaccttgccgtcatccagcaaaaggtccgaacccggcgtcagggccgacaggatttccgggtgaggcagcggggcgcggttgatatcccccggttcccgcgacaggtcgaggcggaaagcctgccctggtttgagagccaccttgcccgccttgaagactccaagacgcagcttcggaccttgcaaatcggcaaggatggcgatgggacggcccagttcggcctccaggcggcggatttccttgaaccgctccaggtggtcggcatgactgccatggctgaaattgaggcgaaagacgtccgccccggcctcccacagcgccctgatctggtccgggctggaactggcaggccccagggtggcgacgatacgagtattgcgcttctgtctcatggagtgctgtccttgtcggcgatcaaaatcgcgcggaaatcgttgacgttggtgagtgtcgggccggtcaccacggaatcgcccaaggcatggaaaaagcggtgggcgtcattggcggccagactgtcctgcggtttgatccccatgacccaggcgcgagatagggtgttgggcgtgatgatggcgccggcaatgtcctccatgccgtcaacgccgtccgtatctccggcgatggcgtgaattccgggctgaccgttgagggcgacggccagagctaacaagaactccacattcgggccgccacgcccctgcccccgaacggtcaccgtggcctcgccgcccgacagcagcacgcagggcggcttaaagggttggccgcgcttggtgacttggtgggctatgccggccatgaccgcccccacatccttggcttcgccctcgatgctgtcgcccaggatatgagccgtgaatccggcgctttccgccaccttggccgcagcttccagggccacttgcggtgcggcgatgacgtgcgtctcggtcaacgccaacctggggtcgcccggctttacgctttcgccccgtccactttccagaacgtcgagaaccttgtcggaaaccacgatgccgtagcgccggatgatggccatggcatcggtgcaagtggtgggatcggccaccgtcggccccgaagcgatattcatgggattatcgccggggacatcggaaatcagtagcgtcaccaccctggccggatggcaggccgccgccagacgccccccctttatggccgacagatggcggcggacgcagttcatttcgctgatggtcgcgccggatttgagcagggcgcggttgacatcctgcttgtcttccagtgtcagaccatccaggggcagcggggctagggccgagccaccgccggagatcaggcacaggaccaggtcatcagccgtaaggtcggacaccagatccaacatttttcgggcggcattcaggccggctgcgtcggggaccggatgggcggcttcggcaatggtgatgcggcggcatggcacgttgtagccgtagcgtgtcaccactaggccggagacttcgcctgcccagttgtcctcgaccgcacgggccatggccgccgatgcctttccggctccaatgacgatcaggcggcccttggggacggcgggtaggtatgccggtacgcactgggctggctgggcggcggcgacggcggcatcgaacatccgtcgaagcaaatccctatgggattgggtcatggtcgatccatccgtgttggggtgagatgcctgcggggcaaaggctttgccctttgccccgcattcttcggattactcgttgtcggcctcgattgccgcgatgaccgcatcggtgacgatccgcgtggtcgccttgcccccgagatcgggagtatgcagcaacgggttggcggtcaccctttcgatggcccgcatcagtcgggctgaggccgctgtctcgcccagatggtcaagcatcatacaggcggtccagaaggtgccgattggattggcgatacctttgccggtgatgtcgaaggcggatccgtggatcggctcgaacatggacgggaacttgcgttccgggttgaggttggcggtgggagcgatgccgagcgacccggccagagccgccgccagatcggacaggatgtcggcgtggagattggtcgccacgatggtgtccagggtctccggcttcaaggtcatgcgcatggtcatggcatcgaccagcatcttgtcccaggtcacgtctgggaactctcctgccacctcggcggcgatctcgtcccacatcaccatgccgtggcgctgggcgttggacttggtcaccacggtcagcagcttgcggggacgcgactgggccagcttgaaggcgaaacgcatgatccgtgtcaccccggcccgggtaaagatggccacctcggtcgccacctcctctgggaagccgcgatgggaacggcctccttgtccggcatattcgccttcggaattctcgcggacgatcacccaattgagtaggcgtggcccgacaccggccagagggcttttgatacccggcaggatgcgggtcggccggacattggcatactggtcgaatggctggcagatgttgagacgcaatccccacaaggtaacgtggtcggggacgtcgggggcgccaaccgcaccgaaatagatggcgtcgaactgtttcaacgtctcgcgaccgttctccggcatcatggtgccatgcttcttgtagtagtcggatccccagtcgaaggtctcgatgttcagacggaagccgccgtcacgcttggcaagcacgtcgagaacctcaagtccggccgccacgacttccttgccgattccatcggccggaatggccgcaatcttgaattcacgcatgatcgatctccattggctcggatggccggcgttagttggaagcggcttgggccgcagcggctgaggccgccgctgacttcctttgcgaacgggcaagcagcagtgtggtcaccgccgagatcgccaaaagcgccgcgacgaaatacagcccgcccatgaagcttccggtcagatccttgatccagccgatcatggccggcccggcgaagcctccaaggttgccaatagaattgatggtggcgatgccagccgcagcggccgaaccggacaggaacatggtgggcatgctccacagcggcggcttggcggcgctgatgccgatattgaccaaagtcagggccaggatgacagtgaagacgccgtcggcattgccagcgaagaccagaccggcggaggccaccagacaggcgccgaccacatgccaggtccgctcgctggtgcggtcggaatggcgcgcccacagaaccatggcgatgaccgatgccgtcggcgggatcatgttgagccaacccaccgtcatggaggatacgccaagctgcttgatgatctgcggcgcccagattcccagggtgtaaaggccggcggaggtgccgaaatagatcagcgccaaggccagaacacgagggtccgccaggccgcgccagatgctgtgcttggcatgcccagacttgctggccgcttcctcgttcatggcattgatcagccaggcgcgttcgtcttcgggcatccaagtggccttttccgggcggtcggtcatgtagaagaacacgacgacgccaaggatcagggcgggaagggcttcgatgatgaacatccattgccagccggccagccccatgacgccatgcagttcaagcaatgcggcggaaatgggagagcccagggccgtcgagatcggggcggccgccatgaagagcgcggttacgccagcacgatggcgcgccgggaaccaatagctgagatagaggatgataccaggaaagaagccagcctcggcggctccgagcaggaagcgcaggacgtagaagctggtgctcccttgcacgaaagccattgcgccggagatcaagccccaggtgatcatcactcgggtgatccaaagacgcgctcccactttttcaaggatcagattggaggggacctcgaacaggaaatagccgaagaagaagatgcccgcaccaaatccaaacactgacgaagtgaagccaaggtctttgttcatggtcagcgaggcgaagccgatgttcacccgatcgatatacgcaataaaatacaagagcatgataaatgggacaatgcgccagctgattctgcgcaggacacgcttttccatatccgtattcatgggacgaactcctcaccctgtattatataattcgcgcgatattgcgcctgagcttgacaggcatggtatgcgggcaagggcgtggcattaaaccgcataggtttatacaaatttttgatataatgagcggttcgtggtcggcagaacatgaaaacaccccgacgagatagatctcatcggggtgtgcctttgctctgtcggcggcaagaaatcaccagctagcgaatgaagcccacttggcttttgatccgctcaagaattggacctttcttctcattgaagcgggccttgttctgttcgaacagattattgcccttggtgtcgatggagatgatcagcgggccgaattcattgaccttgttgacccacatggtctccggcatacccagatcctgccattcggcgccttcaattcgctcgaccttggtggcggcgaggacggcgcagccacctgggaacaccgcatggactgccttgtcctcggcgcagcccgcaaccgtctccggccccatgccgcccttgccgatgatcagcttgaccccggtttccttgatgaactgcttctcgaacttctccatccgcatggaagtggtggggccgatggagaccatttcgaagtcaccctcatcggtcttccgcacgatggggccggcatggaagatggccccgcccttgaggtccacgggaagctggcgcttttgttcaatcaggcggcggtgggccacgtcgcggcaagtgaccagacggccggtcaggtagacgatgtcgccgacattgaggtccgccaggtcttcgtccttgatgggggtcgtcaggatcttcttcacagcaccactccttcatgcgagacgatttcgtaggacaggtccgcattgaagcggatacgcccacggcgatgagcccagcagccggtcgagactgccacgccgatggtggagggatggcgagctgaggactcgatgttgacccccatcacgctgctgttgccagtcagaccctgcgggccgatgcccagctcgttcagaccgtcttcgagcagagtttccatcttggcggcattcgcattcccgtgctgggagcccacaggacgcaggattgccttcttcgacaggcgtgccgctgtttccgccgaggtcgagacaccaactccgatcaacaagggcggacaggcgttgacgccgcgcgaggtgaccacatcgaagacgaaatcgacgaccccctcgtatccctggcccggcatcaacactgtcgaggcgcccggaagggtgcagccgccgccagccatgtagacgtcgatggtcacgctgtcatcgttcgggacgatctcccaatccagccacggaatgcgtgatcccgtgttggtgccggtgtttttctcgtcgaaggcttccacggcgttatgacggagcggacccaacttggttgcgcccagggtcgcattgcgcaggatgtcctccaattcgcccagcaaggggaacttggctccggcggtgatgaaatactggatcacaccggtatcctggcagctcggccggttcagcttatcggctgcctcctggttttcagccatggagtcgaacaagacattggccatcgggttggtctctgcctcccgaagatctgccagcttttccttgatatcggtgggcagtcgcttcccgatgtaagacgtgaacttggtcatgatgtcggtcatgacctcgacgggcgcttgacttgtcacgctcaacctcctcgaacatttcagatacttggcgcgacatccgcgcttgatcttggaggtgatcgtagtcttgtcgtctggcggcgataaatcgcgcatgtttatacaaaaaagtgatacaatccgaattgggagggccgctcttggatctgcatcagcttcggtgcttcatcgcggtggcggaggagcttcatttcggcaaagccgcgcagcgtctcgccatgctgccgtcggctttgggccgccatatccgcatgctggaagaagatctcggcacacgcctgctgacacggaccacccgcaatgtcgcgctgaccgacgatggtgccgttcttttggacgatgcgcgcgccctgctggcccaggccgaggctattgccaaacgattccgggggcgcggacgggatcgggccgcgacacttcggatcggggccattgatagtgcttcggctggcttggtccctctgctgcttcacgactttcgccagaagcgccccgatgtcgtgatccagcttgccgaggacaaaacaatccgtctgttgcctcgtcttctctccgggcggatcgatctcgccctggtccgcccgccggagcatccggacaagagtatcgaattcctgttcctgttccatgagacggcggttgtagcggttcccgagcaccatcccttggccgagtccggcaaggtgacggtgcaggacctagccgaccagcccctgatcgttcccgagcgtcgatcccgcccgcacagtcatgacctgaccatgaagttgttcgccgaagcgggtttgcaggcgcgtatcgcccagttggcggaagagaagcagacgatcgtcaacctagtggctgccaacattaggtgtcgccatcgtgccgcgttggacgtcgcggatggctgtcaccggggtgcgttatatcccccttgaagtgaccgccggtgacggcatgaacaaacttcctctggccgccgcatggatcaaaggcactagggatcttattcgtgacgagatgctcgaaacccttcgagagcgtcttggggtctatgccgagctggcctgagcgatcgtctccgcgaccttccccacagcgaaccgagaatcgatactgtatctgtaggcggctggaattggggcatcagcaacataccgcttaccccaatgaccgctttcgggcgtagcgcctaggcgcttgaaagaccaccatgagcgcagacccgccgtgctatggccatggatgggtatctctgggcgggacaccggcatcccatttagatggtgcggagcatccagtttgatgccccgccaccgcatcagctaaccacggacaggccccgatttttgaatcgcttgagcatatcctcaatcggttccggttcatgattgatgacatcctcttctgccatccatgaaccacagctgacccatttttcgacgacattcacccgttcgcagctggtcgcattccctcggacccaggcgctggtcgaagagatcgtccgatccccgccgaggttggtcaggttaatcttccggatctccgaacccacgccgaactcgggatgctttccgagccaagaactgacgcatgcccgcaaatcgttgacatttggaacccgcgagtttgggaagaactgcttggtgaagatgctcaccatctcgtgcaatttgggggctgacacataggtaaaggcttcatcgccgaaaacctcatgggccaccatttcccaggctggccgttgattgctggccaattcatcgaaatcttcgccatggtaggcgctcggagtttctttgtcccggtgacggacaagaatattgtgcagccagcgcccaacctcgcgggcgtctcgagtcacccagatgttttctgagatccacaactttgcctcgtcgatggtgatacctcgcaagtcggcaataacctctggcatgggtctcgatgctttgattaccgaccaacggcggtcgctattgtcatggccaactcgaattacaccccgaatatcatttccgccaattaggtatagtgccgtgttttcaacttgatatggtcgctgaaatttttcgttgatgacaacatatcggtttccgacaagtcgcttcatcttttccatgtccaacttatcattctgactttcgtcgataaacacgatcgtttttccagcaataacgccattaaacgaacctgatacattatctgtactgacggaagccacttggtgccgtccgaaaattgtgcaaaggacgttgtcgacaaagacatttttgccaattcctccttgcggataaaacaccatgcaggggatggtgaaatcctctggccgtagatatttgcgagcaatcacatgctcaatgtggtcctgcgcctcctccttttcgccggataaagtccaggtgagataattaaaaaatgggtgaacatcatcgacgtttggctggacccagtcgcgccggtcaatgagattgagatgttcctccggcgcctgatcgaaggtggcggtgatatcgcggtaaatgcggccatccgcctccaagatcttggtgaagagcataaatccctcactcgattggagttcggcgtggctgttttgcaaggcctgtttattgaggaatccccaccctgctgggcttcgttcgacgtagctaccttgccccctgataaagcgataatcctgccgctcgatgatctccttgattcggcgttcaaggtcctgccgttgctgttcgcgtagcgcggcagcagcctgcttatccgcctgggccgcagtcttcctggccaccttcaattgttcagcctgggtcgtaaggtcttggattttagcgtcaatggaggtgctcatacgacacctcccacgaacttgccgttggcgacattgatcaaaaagccgagcgagatttgcttgccgtgctgcgcctgctggaggcagtgccgccacttggcatcgcagtcactggccgacttttgccgcatcagacccccgagggtgacggcacggaagtcatcaagggtgaatccgttgctggccatggcaatgccaattcgccaccaaaggggctcctggccgacataccgccccttgagcttagtcagaagtttctccctttctgtgtcggtgatctcttgatggtcagccaccggggctgctttttccctctcgatgcgggctgctgcggcagttgcccaccctgaccattccaatacctggccatcgttgacccatgattctgccaggaccaatcgatcggcgggacatgttgggagataaaatccgcgactcagatcaagctgtgaccgatccccgatgcccgcccaagttttgatctcgggacgcatgtcgcggaacactgctgctggtgcaggcgtgtttaaagggaagaacgcccgaaacgcgtcctgaccactcttttttgccgtcctgtgcgaatacgttgaataggccacgtacctccacggtcggaacttggatcgaaaggcggaaatgctgaagccgccatctatgtccaggcccagcatactgtattcgaccacattggccgcacagcgtcggactggatctccgccaccttcaacgaagcgggcgggacagaccatcagggtgtccttggcctcggtcgtggtatgggtggtcagcaaagaacatactgcgttccagtcggcaccttcgccaattgaagcaatgttgtctttagagtttccaaaaaatgttaaatgatacttcatcgttacacctctgttgatatcccagcgggaggcttgcctcctcccgccgggaagttgtcgcgaggtggtggcgacgatgcgtatatctatttatcaatgcaattaacgcgcatagaccatatttattcatcgtaatatctccacctcgtttggcgccgtcacgggcaaggacggcattagttgtatttattgttgttagtcgcctgagtgcgtcgatattcggttgtcatgtatgcggactgatcgtggtgaataaatgtcgcaatcgcagccataaactggttcatccaaaagcgattcatgcgtttgaagtcatatccatgcacgctcaccacatgatcaatgatatcacctgacgtcttgagtgcgttcggaggaaatccatctatattttcgtatattgctcgaagatcggcctccgggaggccgacgccaatgtcgttgatttcaaaaattactaatgctttatcattcatgatctcatcaatccttatgattggcccggcgcggaatgcgtaggcaactcacaggacgatatctgtcgctgtgacattccgtcattatttcgttttacttcctgtgttatgcctgcctggaagtgttagttgccatggaatgcagccatgccgagctagcggcaataattcatcccccttgtgcgccggcagaatgcagtattcagctcataattctgtcttggcgcccttggcctggcgcagaatcaaaagtgaattcttgggaatgctgcggaaacgccgggacgagcgtcgcaatttgttgcgccatcttgatggcgaaagatatcgaaaaatccaaaacgtggggctaacgttgcgtcatacccaagcaacgcggaggtgaaaatgggtgtgacgaatacaataggaaagcacatgtcaaaattgtgctcagcaagccacgcaatggcgacgcttgatcaagacttgtttgttataaagccgccgccattatttgatggtctggacgttattgttatacgacttaccgatcaagcggcagctgaattgcttcgatctgctcgcaaacgcggcgatgtcatcaggcgtgcatccactggacagcgatggatggggacggctgaggatgtctgcctgattagcccgaatcctaagcggcgcaacgagctaatggcaatggccaaagcaactttcggcccaatgattaaattgtaaaaaagaggatagtaaaatgagcaacatgaatgtagcaaactacttagaaaaaagtacaaatatcacgctaacaggcagagacgacaatgagcaacaggctgtctatgtcagtattaatgaggaggaatctgtgttctgcgagaatcactcccatatagagcgggctacagatcctaatggattagatgatcttacgtcacgcaaaatggaagagcttgtgtgtaagattaatgacatatggtctaaagttaaacacataaatgatagcgctataggcgcgcgtaatggatgtgtggagcgtgaaagtggcggctctaaatcagatcgtcgcgacgatatagagaggttgctggcaataaagcgcagctatggagttgagtactctcgcattttgctttcgatgagagatgctgagtttcaggatgacgtaattgggcacctccagattatcaatgacaagatcatcggcggcattcttgatctgggcgatctagaaagatttgactttagtgatgcggagcttacggcggtagaattaaattacgagtattgcattgaatgtgaggagataagagataacgccgaatacgctatttatggcaagtatggagttttggctgagatttgtcgcgcacttgaaagacacagaacaaagttgcgaatgcttttctctgatgctgcagcgaaagtgacgtagctattggttttgacataggcgattttggaggggaggtcaacgttgacctccgcttcatgctaataaattggatcgctcgatggaaactatcttttagaaatacagcgtaaatgcggcttgcgactgtgagtatttttgaacaacatactaagatatcagtttatttttataggaaagcgcttctaattgaaataattttgcttatctcatcatgatatcatttgcttcatgacgatcagactgcagattgaccagtcgctgcggctatgtcactggtatcggtaacaatttcagatcaaagcctcaaggaggcacaatcaatggctaatcaaaaggtatcttttgctgctcgcatcgtggcggcctatttgcgaaatcacgaggttgccattggcgatctttctgggatcatcagcgctacctacgcagccttggccggtaccgatgcgccgcccccagtcggtgcggatcgtcctaccccggcagtacctatcaaaaagtccataacccccaatttcgtcgcctgcctggaatgtgggaagcgccagaagatgctgcggcgccatctgtcgacctcgcatggcctgtcggtcgatgcatatcgatccaagtggtctctgcccgctgattacccgatggccgcccccaactattcgcaaaagcgctcggagatggccatccagatcggccttgggcggaaacccaagacgactgttgcgaaaaatgctgccaccgacgcggaggagtctgagaaggcaccccacacttatcctgcgtcgagatgggccaagccaacgggctgattacccaacgatgctcaagtccatctgaaccccgcgtaccagcacctcgggggcaacagagccacgcttgcctggcaccagcctgactaggccgtattggctcatggttttaagggttctggagagattgctggccttacggccgctcatgacctccagctcggccagcgatgccgggtgctgttcatcaataatccgcaacagcctgcgatttggttccgacaacacctttgccaacgactcgagcgatgtgaaccaaatctgcggttcatcaggcaggcgccgacgttcaccacgagcaatctgcaaggcgcgctcacgaagctccgtatgggtggcgatgccgaccttggtcttttcagccatcgtgttgctccttcaggatgcgctcgatctcatcaaagaaatcggcaatcagcttctcggcggtcacaaactggtagggccgaccctcgtcggattcgtcgcggtgccaatggtcgaaggcggtctggcgttcgacaaacttaccgccacgatgcgcaacgccatgggcgttgtcgtatcccatcaaccggcggccatcgcgggaatggaatgtcagcgaatacgaaacgccgtggggtttttcagccgtcgcttcgatccccttgaccttgaatcgggcgacataaccgtcatcgtagatgatctcttcaccatcaagatccagcagatatgtgagggtctgatcagcatgtggcatgcctacgttcatatcagttagtgatatgggttggcaagttcaaggctggattaatcggttggcggcttgggccagactcacactttactgacatggcaataaacgacaaaaatatcgtttgttatcaagttattacaatattccgctttattcctaatgctcgattaggcgtgattctgcctgatcatggtccttctgccgatggaagggtagtgccatccgatttggcaaacaaaatggtaaacatttatggtaaacgcgccttgcggtgcatcttttaagtcgttgattttattgaataaatcggcgatggcgtccccacggggattcgaaccccggttaccgccgtgagagggcggtgtcctaggcctctagacgatggggacgtcgaggcgcgaggcccgctttatgtcggaaagcgggcggcgtggcaagctcttttttccgccacttcaatacggacggcaaacacccggccggcatcccggtccaggcggtgggctcgcatctgtacggtctggggacggcccgcgccatcggcggcggttccgacgatcagccagatcagttcgggctcccaggcctgagccagatcggtggccgaggggctggcgctgccgtcggggtgggagtgccagtggccaaccacccgcagctcggtgccgcgcaccgcccgttcggcggcgaagcgcaccgccgggtccagttcgaagcggtcattgccttcggcctcgagcagattgcaggccggcatgacccgcgtgacggtcacgatgcgccgccccgtgccgatcagcaggccgcagccttccgacggccaggcggcttcggccgcgctggcgatggaggccatctgttccgccaagaggaccagcatgccgcccctccccgcctcgctaccggacggccggttcgggggtcaggacaaagccgcccgccaccttgccgagaccgggatcaagcaccacaatccgttcgggcccgccgccagacaggcgcagcacgacccgatcgccagctaccaccatctgctcgaccctggcgccggcgggaatggggaccgccagttggccgaattcggcaaccgaaggcgcgccgacccggctggcgatggccgaaggcgttcccttccccggcgctttgctgtaaagcccatagccaaggacgcccaagccggccagcagcagaacccccaggaacagcaccaatcccttgatcgctctcatgatcttcgcttcaatccctgttcgtccatggacatgcccgtgacccagcgcctgaccccgcccgccgtcgagcccgaggaggccggcacccgcctggaccgttggctggctctgcgcctgcccgaactgtcacgcacccgcatcaaagggctgatggaggacggacgggtcagcctggaggagacgaccatatccgacgcctccctcagggtcaaacccggccagtgcttcgtggtggacgtcccccccgacgctccggcccagcccgagccccaggacatcgccctgaccgtggtctacgaggacgaggatctgatcgtcatcgacaagccggccggcatggtggtccatcccgcgccgggcaatcccgacgagaccctggtcaatgccctgctggcccattgcggcgaatccctggccggcatcggcggcgtgaagcgacccggcatcgtccaccgcatcgacaaggacaccagcggcctgctggtcgccgccaagaccgacgcggcccaccgcgggctggcgacccagttcgccgcgcacaccctggagcgcgcctattgggccctggtctggggcacccccagcccccgacagggcgagatcgagggcaatatcggccgcaaccccaacgaccgcaagaagatggcggtggtgaaaagcggcggcaagccggccctgacccgctaccgcgtgctcaaaagcttcgccggcggcgccgtcagcctggtggaatgccgcctggccaccggacgcacccaccagattcgcgtccatatgaccacgcagggccatcccctggtcggcgatccggtctatggcaggattcgtggccacaaaggagtggtcctaccacctgaggtgaagaccgcactgatccaattcccgcgccaggcccttcatgcctacctactcggtttttcgcatcctactaaaggatatgacgtccgcttcgaaagcggtatgccacttgatatcaacgcattgatgcagattttagaggttctataaaaaacgcctatacttgagctagcgactatgacattatcgtctcatcagccggtgacgacggatcccccgtgatgggcccgatccgataacgagggaaaaccctccgcgccgaaagaggagatgagacgatgacggcaatcgcttccagtctgtcgctcgcgcccgaaggcaacctgacgcgctaccttcaggacattcgcaaattccccatgctgccgccggaggaagagtacctcctggccaagcgcttccgcgaacatggagatttgccggccgccaaccggctggtgaccagccatctgcggctggtggccaagatcgccatgggctaccgcggctatggcctgccgctgggcgagctgatcagcgaaggcaatgtgggcatgatgcaggcggtgcgccgcttcgaccccgaacggggcttccgtctggccacctatgccatgtggtggatccgcgccgccatccaggaatacatcctgcattcctggtcgctggtaaagatgggcaccaccgccgcgcaaaagaagctgttcttcaacctgcgcaagctcaagggccagatgcaggccatcgaggaaggcgacatgtccgccgagaacgtggccaagatcgccaccaagctggaggtgaccgaggacgaggtggtcaccatgaaccgccggctgtccagccccgatcactccctgaatgcgccggtgcgcgccgagggcgagggcgagtggcaggactggctggtggatgaccatgaggaccaggaaaccgaactgggcgagcgcgaggagcttggacagcgccggcagatgctgaccagcgccctggaagccctcaacgaccgcgagagggccatcctgatccagcgccgcctcaccgaagaccctgccaccctggaggacctgtcccagcgctacggaatctcgcgcgagcgggtgcgccagatcgaggtgcgggctttcgagaagctgcagaaatcggtgaagtccgcctccgcccaggccgaggcccagaaccgggcgtaatggccccaggaaccgcaaaaaagcccccggccgatggtcgggggttttttgtgagctctctccggtcccgacggttcgagggactcgccctcagcccttcttggagacctcgtcgccccaatcctcgaccagcttcttctgagccgccttcaggttgttcacccgacgctggctgctggcggcgagatagctggccaccatgggtggcatggcggcatagatgccccagccgatagccgagcagccataggccgtcatcagcatgatgggatcggtcagcatgcgcagggactcgtccagggtatggacaccgaaccacaagccgaacagataggggaacacaccggcgaaattgagcccgccgacgcacaggaaggcgtatttgttgggtcccttctcggtggcccaggaggccaggtgggaagcatgccgatgccgaccagggctacggtcggcaacgagaatggcaccagggcggccaggaccatcaggaccacgcccttgttgatgcccgctccgccgctgctggctttcttcttcgccgcagccgccgcacgcgcctgttccaccgctgacattttctttgccatgggccgaagcatggcaccacggcccgccaatggcaatgcggcaggcgtgcaagatcagatggatacctctaaaaaaccgccgaaatcaccacaatggaggcggtcaccatggcgacaaggatgccggtcaccgccgcggtctggcgaccgatcttgtcggcctcggcgctgcgctcctcggtttccagcaaaatatgtttgatctcctcctcggcggccgaatactgggcctgggcgaaggtgaattcctgctcgtcacgtacgcgttcctcggcgttctccagcaggttgtagatctccaccaccgatcctttgcgcaccagacggggaatttccttttccagttcccggcgcttttcccggccgtggaagccctggacgatgggagcgatcatggctccgacccaggcggccaggccgggcagggattccggaccgaggcgatattgcagcaccgcgaacagattgagcgccgccatcatggcaatgctctggttgggatcgcccagggcggtcaggttacgatcgatgtcggaccgcatgcgggcgccaaggaaggcggcgatgtggcgatccaccgggatctgcttgccgtcggcacgcttcgacgacgccacattcagggccggcagcaattccttgacctcgaccacgtattcctcgcccagcagcgagctttggcacggcagggcgtcgttgagttcgtacaggcagcgctccagcccatagcccatgccggtctgggacaggtacgagcgcaactccttgaaattggattccatcagcgagttatcgggctggtactcgccgcgcatctcgaaccaaaggcgcggcacttcgcgcaggatgatctcggtcagcagcctggtgtcgccccggctggccatcaccgccgccagggccgagccgaagccgtcgggcatggcgttgaagcccttgtagcgaatgggcgccgcctgatccaacaggatcagcaccttgcacagcatcaggtcggtggaacttttcttgtcggtggtggagttgagcgccatgcgcaccacctcggccaccacattggccttgtccttgtcctcgacggcacggcgcagccacagctccagcttgccctccaccaccggcggaatggcctggtcccagttcttggacatggcctgggacagttcgcggccgttgaagtactccttgcccatgaagggaaagccacgggccgcgcgcttctcgccccggggctgcaggggcgacatgcgccgtcccgacagccacagatccagatcctcggcgtcccagcgctggctgccgtcatcgcacagcaggccgcgcagcagctcgatcatgggcagcggcaaccgttcgtcgccgatcagcatgttgtagctgccctgctggatcttcatgcccaggatggcgtcgtcggacaaccccgccaccgggttgcgccccaggatcaggaaggcgatggtcacgcccagggaatagtaatcctcggtatgatcgccgctgccccgggcgatgggagtgcacatccccgattccaccgtctcgaacagcacgggctggtcgaaggccggcggagcgcagacgcagtcgccaaaggccaggcgctcgccattgccgtcggaaaagaacagattggtgggccggatggaccggtgcggcacgccgcgcccgtccatttcctttagagcggcggtcagcggttcgatcacccgcttggtgatctggtactcgtcgatgcgcggcacgtccgagcgcatgttggccatcacccggttcccgcccgggcgctcgtagaccacggtcatgcactggcggccggcggggggccagttcatgggcccccactccaccagctgcatcaggcccggcgtcgacacgcccttcagggcgcgcatggcgttgacgcggggcggcagttccggcttgcagatcaggccgaacagggcgcggctgggatcacgcttatcctcggcgacgaaagcgtcggccgagggcgtggacagttcaggcaggggctggttggagcggatggtgtagcggtcgcgcaggactccgggcggaccggtctgcttgaccacctccaccttgacgtcatcgccatcgtcgtcctcggccggatcgatttcggtctcgatctcggcctcgtcgatttccgacatttgccccttccatgggccgaccccgtggggggccggactgttctcagtctaaaggcggaaaggccgtcctacaatcaagtcgcaaagggatcgtgcaccaggatgctgtcctcgcgctcggggctggtggacagcagggcgaccggcgcctcgatcagttcctcgatgcgacggatgtacttgatggcggtggcgggcagatccttccacgaccgcacgccacgggtgctctgggaccagccctcgatgacctcgtagatgggctccacattggcctggccggtcatggaggccgggaaatggttgatcaccttgccatccagcttgtagccggtgcagatcttcagttccttgaagccgtccagcacgtccagcttggtcagggcgatgccggtgatgccgcccaccttgaccgcctggcggaccatgacggcgtcgaaccagccgcagcggcgcggacggccggtgacggtgccgaattcatggccgcgctcgccgatgctcttgccgatctcgtcgaacagctcggtggggaacggcccctcgcccacgcgggtggtgtaggccttgcagatgcccaggacatagcccacctgccccggcccgacgcccgagccggtgccggcgttgcccgacacggtgttggacgaggtgacataagggtaggtgccgtggtcgacgtcgagcatggcgccctgggcgccctcgaacaggacgcgcttcctggtgtggcgcacctcatccagatgctgccagaccacgtcggcgaagggcaggatcttcggcgccacgtccagcagcttggccagcagctcggccccgtccacctcggcggcgcccaggccgcgcagcagggcgttgtgatggcgcagcagggtggcgatcttggccttcagcacggcctcgtcggccagatcgcagacgcggatggcgcgacgccccacgcggtcctcgtaggccgggccgatgccgcggccggtggtgccgatcttggcggtgccgctggcctcttcccgcgccttgtccagatgggcatgcagcggcaggatcagacaggcgttctcggcgatcttcagcacctcgggggtgatctccaccccctgggcgcggatgcgctcgatctcggccagcaaggcccagggatcgatcaccacgccgttgccgatgatggacagcttgccgcgcaccacgcccgaaggcagcagcgacagcttgtaggtcaccccgttgatgaccagggtatggccggcattatggccgccctggaagcgcaccaccacgtcggcgcgctcggagagccaatcgacgaccttgcccttgccctcgtcgccccactgggcgccgaccacagccacgttcgccatacctttaagtcccctaacctattcgacttcgacgataccatcgggaccgaggcgatgcctgcagccctgatgctttgcttccacttgcgggtcggcggcggggtccagccccgacaccgtcacccagccctgggcgcggaacgcctgggcccaggcccggggcgttcccgccggaacgaacagccgcttggccggcttggggccgggcagcgccgccagaacggaatccatgaacagagtggcgccggtggccggctcgccgcctccgccctgatagcgcccgccgcgccccagttcggcacccatattgcgggcgaacagggtgaagctgaggccggtatgatactcgaatccgcgattttccaccggatcgaccgtcagggtcagcgacggcaggtcggcaccggccagttccaccacccgggccagacggtcgcgctcggcggcggcggcggggggcaggtccagggcgcacagctcggccagggcgcgggcggccggaccggcggcggcgatcagcgcctgcagcagcggcgcggcggctccgccctgggcggcaaccgtggcgctgtccttgtggtcgagggcggcgcgcaggcgatcggcggtctcgccattgatcccataggcggcgaacaccgccggaaccagggtgggcagggccaggtcggcggacaccccgggcacgccgagatcatcgagcgcctcggcggtcatcaccaggacctcggcatcggcgccggcatcatccgagccgatcagctcgattccggcctggccgaactgccgctcggggcgcagctgggtgcccttcacccgcagcacctgaccggcataggacaggcgcagcggccggggctgggatcccaggcgggtggcggcgatgcgggccacctgcggcgtcatgtcggcgcgcaggcccatcatcttctggctcatgggatccatgacccggaaggtctgggacgaggtccccccccccgcgccgtccagcaggctttcctcgaattcgatcagcggcggcttgacacgatcatagccatgacgggcgaacatgctcatcaggctgtggacgacggaggcttcgaactccgcgtctgggggcagcatgtcgcgcaggccggcgggcagcagggcccgattggcggactcggtcatctcttggtgtcgcaacccggaacaagggcgggcgtcgcaatgacgaccgctcggttatctggcaatgcccgatgtatcgcgtttggcccccaggggcaaacggaatccggggaatggcgctctaaaagcgccgacggtcaccaagatcgtccaggcacttcatcacccccaccgaggcctcggcggcgcgggcgatggcggccagcgccccgtccaggtcgccattcttgaagcagcgggcggcatcgatgccgttccggtgcacctcgcggtggggcgcttcaagggcggcgtaggccggatggcgcaagatactctcatccgtgagggtcgagcaccacttgcccaggcggcatttggtgtgatcggccagatcgtcgggattgagcacctcgcgcccgaccaccatgtcggcaaggcgcttgcgccacagcatgtggtcggacttggccacatgcagggtgaagtcgtcgatctccagcgccgccatctcgttcagggcggcgacgatgcccttggaggcgccgtccatctcctcgaccacgtcgttgatggtggcgacattgcgggccgacaggccggcgatggcgccgacgccctcggccacctcggccgaagcggcgctctgctggttcaaaatgccggcgatctgggccatcttgaccgagacgccctggacctgggtggacaggcggcccatgccgtcactggtggcgctgatgacctccttgccgtgctcgacggcgccggcgccgtcctgcatggtgcggacgatctcgcccatctcgacccgcagggattcaatgcgggcccggatgtccacggtggcgcgcgccgtctggttggccaggttcttcacctcgttggcgacgaccgcaaagcccttgcccgcctcgcccgcccgcgccgcctcgatggtggcgttcagggccagcaggttggtctgcgacgcgatgtcctcgatctgattgacgatgtcgccgatctgcaccgaggcctcggccagggaatccaccttgccggcggcggcctgcaccgcctcggcgatggcctgcatggcgccgatggcctgatcggcggcgccgtggctttcctgggcgacgctctcggcggcgccggcatcctcggcggcggccttggaggtcctggcgatctcggccacgctcgacaccagctgttcggcggccacggcaatggcctgggcgcgacgatccacctcgcccacgtcgcgcatcatgccggcggccttggtcaccgcctcgttgacgttgaccgaaagaccgacgtccagcctcagattggcttgcgcctgggattccagccggtcggccagggccttgatcttggcggtaacggggcaggtgccggcgggaacggagtgatacttgccagccagaagctgatccagggccgccccgatggactcggactgaagcgacgacagcgcctggtcattggccacgtccatgggccgcagatcggccttggcagccgtctttccaccgaaaatccaagccattacatccccctgggtgcctacccctaatgtccacaccctatgtataagcccctaatgcagcagggcggaatataccatttgtattacagatatgtttcaacctaccaaatgctgcgtgcggcttcgtccagacacggggaagggcatcaaaaagctgggggccgcggcgtcaccgccgcgcccccccttgccggtatcaggaatgaaccgggatcaggcgaaggtcaggaacttggcctgcaccacctggggcagggcccggaccttttccagcaggtcgttggagaccggctggtccacctgggtcagcaggatggcgtcgccgcccgcctcggaacggccgaggtggaaggtggcgatgttgacgccgttggcgcccagcagggagcccagggcgccgatgaagcccggcttgtcctggttggtgacataaagcatgttctggcccagctcggcctcgatggagatgcccttgatctccaccacgcgggccttgttgccgccgaacaaggtgccggccaccgaacgctcgcgcttgtcggtggtgacggtcaggcgcaccagggtgtgatagtcaccctcggactcggacttgacctcggagaccttgatgttgcgctccttggccaccacgggggcgttgaccatgttgacggcctcgttcatgggcttgagcagcccttcgaggaccatggcggtcagcggcttggtgttgagcgaggccacgtggcccagatactcgatcttcacgtccttgatgccggtctcggtcaactggccggcgaagctgccgatctggttggccagcgtcatgtaggggcgcagcttgggcgcgtcctcggccgacaccgacgggatgttcagcgcgttggtgacggcgccggtcagcaggtaatcggccatctgctcggccacctgcaaggcaacgttttcctgggcctcggaggtggaggcgcccagatgcggagtgcagaccaccttgggattgccgaacagggcgttttccttggcgggttcggtcttgaagacgtccagcgcggcaccggccacctggccggactccagggccgccagcaggtcttcctcgaccaccaggccgccacgggcgcaattgatgatgcgcacgcccttcttcatcttggccatggccttggcgtcgatgatgttgcgggtggcgtcggtcaagggcgtgtgcagcgtgatgaagtcggcgcgggggaacagttcgtccagttccaccttctcgacgttcagctccttggcgcgctcgacggagaggaaggggtcataggcgatgacgcgcatgcgcaggccctgagcgcggtcggcgacgatggcgccgatattgccgcagccgacgatgcccagcaccttgccggtcagctcgacgcccatgaagcggttcttttcccacttgccggcgtgggtgctggcattggcctcgggaatctcgcgggccagggcgaacatcatggcgatggcgtgctcggcggtagtgatggaattgccgaagggggtgttcatcaccacgatgccgcgcgccgtggcggcgggcacgtccacgttgtcgacgccgataccggcgcggccgacaaccttgaggttggtggcggcggccaggatctcggtggtgaccttggtgttggaacggatggccagaccgtcatactggccgatgatggccttcagctcgtcgggagcgaggccggtcttcacgtcggtttcgatgccgcgatccttgaagatctgaacggcggcggggctcaacttgtcgctgatgagaaccttgggcatctggacttcctcgagtgggaaaagggctcacatggagttcgggcgccgcctttttgaaaggcggcgcccggttcacggtgttttcggcttaggagaccttgggctcgaactcggccttgacctgggcgaaggcccagtccagccagggcaggagcttttccacgtcactggtttccaccgtggcgccgccccagacccgaaggccggcgggagcgtcgcggtaggcaccgatgtcgtaggccaccccttccttgtcgagcagggtgacgatcttcttggccgccgccgcctggtcatcgggcgacagcttggcgaagaacggcgccttgacgatcatgcagatggaggtgcaggagcgcaccttggcatcgtcggccagattggcggcccaggcggacttgtccaaccaggactgcaccgccttgagattggcttccgagcgggcgatcagggccttgaggccgccgatggactcggcccacttcagggcgtcgatctggtcttccacggcgatcatcgagggcgtgttgatggtctcgcccttgaagatgccttcgatcagcttgccgcccttggtcatgcggaatatcttgggcagcggccaggacggcttgtaggtctccagccgctcgacggcgcgggggctgagcaccagcatgccgtgagcaccctcgccgcccagcaccttctgccaggaccaggtgaccacgtccagcttgtcccagggcatgtccatggcgaacacggccgaggtcgcgtcgcagatggtcaggcccttgcggtcggacttgatccagtcgccgttgggaatgcgcacgccgccggtggtgccgttccaggtgaacaccacgtcgcggtcgcaatcgacttccgccagattgggcagggtgccgtagggcgccttgaacacgcgggtgtcttcgatcttcagctgcttggtgatgtcggtcacccagccctcgccgaagctttcccaggccagcgcgtcgatgccccgggcgcccaggagcgaccacatggccatctcgacggcgccggtatcggaggcgggaacgatgccgatgcggtaatcggcgggaatgcccagcacggaacgggtgcggttgatcagctcttccagcttggtcttgccgatcttggcgcggtgcgaccggccgacaggcgtgtccttcagcgcgtcgaccgtccaaccgggtcgcttggcgcaggggccggaagagaaattgggattggcgggcttggcagccggcttggaaatttcgctcataagatgtaaccctccctcgcagaagggacgcggcccgttgggggaccgtggcccgggcggagtgtatgagggcgccgatggattcgcaacgaagcatttatccggcgtgcatattccttgccggtggtggcggccccggcaaggccttgctatcttcgccgccatgaccagcccattcgacgccgccgccgcccttcgcgccatgacctcgaccgccccggcgggcggcacctcgcccgttcgcgatgcctcgttcgacgcggtccgcgccctggtaggcgccgccatggccaagggggccgacgcctccatcgcggcggtgggcgaagcccaggccctggccgagggcctgtgggcccaggtccgggccactccggccttcgcattgggcacgcccaaggccgcctgcggcaaaggctgcggctggtgctgccaccagcgggtgggcgccaccgccaccgaggtgctctacatcgcccaggccctgcttcggcggccggagggggaagccctgatcgggcggctggacgcctggagcggcggacggccctgcgtcttcctggtagacaacgcctgtgccatctacgacatccgcccgttcaagtgccggggcctctatcatacggatgcgcgctggtgcatgggcacctatgccaagctcgacgcgccgctgttcggcccggctccctcgcccgagcatcaggcgccgcccaaggacgtgttcgacggcgccgtgttcgggctggcccatcccctgcacatggccgggcgcgattgccccggcgtggatttcatccccgccctgaaagccgtcattcatcagcccgacgcagcgcgggcctggtggcggggcgagacggtgttcccgcccgaggttcgccttcacgactggttcccgccggtcaggggacgcggcaagcctctcaaggtcaagggccgtgggcgctgacgacgcctccatcgataccagggtgcgggccgaacaggtccgcgtcctggcccgcaacctgcccttcaccgccctgaccggcaccgccatcgccctgttggccgccctgggcgccgccccggtggccggcgagatggtctggtggtgggcgggagccttcgtggcggtggcggcgctgcggctggccatgctgcggttttactggactgtggccgaccgcgaccggcggccggatttctgggggccttacatggccttcaacctgctgctgtcggggctgatgtggctgatcttcgggctggccgccttcgacgcccatgacgccggccacgccctgttcatcgccgtcatcctgaccggcctgaccgccgcctccctggccagcctgtcggcctatttccccggtcagatggccttcgccctgccgaccatcgccggcttcgtgattcccgtcgccctgtcgggggaacgagtgatgaccattctggcggtgatggccgccgtcttcctggtggtggtgaccctgtcgtgccgggcggcggagcgggtgctggtccagtccatccgcctgcgcttcgagaacgagcggctgatcggcgacctgcgccgggccggcgccgaggccgaagccgctaaccgcgccaagtccgacttcctggcggtgatgagccacgaactgcgcacccccatcgcctcgattctcggcttcgtgcaactggccggcatggcgcccaccctggcccgggccagggcgatcctgcccaaggtcggccgggcggggcggcaccttctggccatcgtcgacgacatcctggacatctcgcgcatcgaggcgggcaagtacgccctggacctcgccccgttttccctggacgagatgctgggccacgtcgaggacctgacccgtcccctggccgaggaaaagggcgtggaactgtcgctgcagcacagtgacgacgccccggcccttctggtgggcgacgcgttgcggctggggcaaattctcatcaacctggtgggcaacgccgtcaagttcaccagccggggcgcggttcacgtcaccgtgcgcaccatgcccatcgacgagatcagcctgctgctggaatgcgaagtggcggattcggggatcggcattcccgccgaccggctggaggccatcttcgagcccttcacccagggcgacggcagcaccacccggcgctatggcggcaccggactggggctgtcggtctgccgcactctggtggagatgatgggcggcgagatcaccgtggaatctcagcccggccggggcagcgtgtttcgcttctccgccctgctgggcgtcgccggagccccccaggcccagacggaagcgaccgagtccgaaccggccctgtccccggacttcaaggccctggccggccgtcgcgtgctgctggccgaggacaatccgcaactggcggagatctattcagaattcctcggcatgaacggcattcaggtcattcgggtggaaaatggtgcccaggtggtcccttgcgctctcgacccggcccggcgccccgacctgatcctcatggacatggaaatgccccagatgagcggcctggacgccacccgggccatccgcgcccatctcagccgtgacgaattgcccatcatcgggctgaccgcccatgccttcgcctcggcccgcgacctgtgcttcgcggcgggcatgaacgaccagttggtcaagccggtggactttcacctcctgacccgcgccatcatccgcaccctgggcgcccctcccgcggacgcccacggctgaggtgaggggcagccctcagagtatcaattggccctgaacgaacggccgcgcgcggccgccgatcagcacccgctctccccggttctccagccacagcgtgccgccgcgccgagacagctgccgcgccgtcagcatggccttgtccaggcgccgggcccagaagggcgccagcacgcaatgagccgagccggtcaccgggtcctcgtccacgcctttgcgcggggcgaaaaagcgcgagacgaaatccacgccgccgccgcccggcgcggtgacgatcagcccccatcggttcaactgcaccaccccggccatgtcgggcaccagcgccgacacacggtcggcatcgtcgagcacgcacagcagatggtcacgggtggccagtacctcacgcgccggagcccccaggatacggtcgagtccctcgggaaacacggcgggacgcggcgggttggcgggaaaatccagtaccaggcgatcgccgtcgcggatgacggccagcggcccgctcctggaggcgaacacgacccgctctcccggctccacatggttcagcaccacccaggccgaggccagggtggcgtggccgcacagatccacctcgatcctgggggtgaaccagcgcacccgccagccctccgcctccttgaccaggaaggcggtttccgacagggcgttctgacccgctaccgcctgcatccaggcgtcgtcgggccattggggcagcaccaccaccgccgccggatttccggagaacggcgcgtcctcgacaaaggcgtccacgtgccagaagggaagcgcgctcatgcctgaaactccttgaccgtgtgcccatggttgagggggccgtggccgcttcccaggccgggggcggtctcgatggccctgaccagataggccctggcccgctccaccgcctcgactagtcccaagccctgggccagcccggcggcaatggctgacgccagggtacagccggtgccatgggtcgaacggctggcgatgcgccgcccggtgaagcggcggaggccgccccccgcctcggccagcacatccaccagatggtcaccctccagatggccgcccttgagcagcacggccttcggtcccaacgccagcaggtcccgcgccgcgccctccatgccgtcggcgcccttgatggcgcgccccaacagcacctcggcctcggggatattgggtgtcagcagccgggcgcgcggcaccaaccgcttgaccagcgctccggcggcgctgtcggccagcaaagcggcgccgcccttggccaccatcaccggatcaagcaccaggggcacggcgggagccagctcctccagcgccagggccaccgtttcgacgatggcagccgaggccagcatgccggtcttgatgcagtcggcgccgatgtcgctgaggacggccgccatctgcgcccgcacgaaatcgggaggcacctcgtggatgccgctcacccccagggtgttctgggcggtcagggcggtcaccgccgttgcggcaaagccccccaggcaggtcaccgccttgatgtcggcctggataccggcaccgccacccgaatcagaaccggcgacgatcagaacccttcctcgcatggccaagaccctcttcaatcaagagatttaatgcttttgacacatttttaatagggatacccataagctgcattcgggtgacattttgtagcggcagctaaaataaggtgttcaccctcttgtgcgccgcaatatgggtgcgtatattcgcctatacgaaagcatggttacacatcccacgaggcacatcatgcagtacagatgggaagagatcgatcagcttgccgagattctcgaggcggaagttgccggccatccggtagacgtcgaccgcgcccgcgaattagccgaacgcctagtccggctgtgcccggacatcgcccggaccatgagccgggtggtggagcgcttcgctcccgaagccgccacggcggcggcttaacagccgggatcaaggcaagggggcagaagcccccttttttacgccctcagcccgccgcccggcggatggtctcgacgatggcatcgaccgaggcctcgaccaggccctcgtcctcgccttcggccatcacccggatcagcggctcggtccccgacttgcggatcagcagacggccctgcccggccagcttggcttcggcatcgcggatggcggcctcgacggcgggcgcggccagcacctcggccaccgagcccttggccacccgtacattcttcagcacctggggcagcggcgtgaacaggcgcagcatctcgctggccggcttgcccgactgcaccagcgcggccagcacctgcaaccccgccaccaaaccgtcgccggtggtggaatggtccgacaggatgatatggcccgactgctcgccacccacgttgaagccgtcgcggcgcatgtgctccagcacatagcggtcgcccaccgccgtgcggatggtcttcaggccccgctggtccagaaagcgctccagccccaaattggacatcaccgtggcgacgatgccgccgcccttcagctgacccgagcggtgccacagatcgccgatcagcgccatcaactggtcgccgtcgatcatgtggcccagttcgtcgcacagcaccacccggtcggcgtcgccgtcgagcgcgatgcccagatgggcgccatgggccaccacctgctcgcgcatggtctcggtgtgcagcgaaccgcaattcttgttgatgttgaagccgtcgggattcaccgccacgggaatcacctcggcgcctagttcccacagcacggtgggggccaccttgtaggcggcgccgttggcgcaatcgaccacgatcttcaggccgtccaggcgcaggccgcgcgggaaggtgtacttggcgtattcgatatagcgcccggccgcatcgtccaggcgcttggcgcggcccagatggtccgagcccacccggcaggattccagtccgttggacatggaggcctcgatggtcagctcgtcctcgtcggagagcttgaagccatcggggccgaacagcttgatgccgttatcctcatagggattgtgcgacgccgagatcatcacgccgagatcggcgcgcatggaccgcgtcagcaaggccaccgccggcgtgggcaacgggcccagcagcaccacgtccatgcccaccgagatgaaacccgcggtcagagccggctccagcagatagcccgacagacgggtgtccttgccgatcaccaccacgtggcgatgatcgccgcgggtgaagtgccttcccgccgccatgcccagtttcatggccatctcggccgtcatggggtcggtgttggcggtgcccctgatcccgtcggtgccgaacagcttgcgcgtcatcccgttatgcttcccttcgtccgaaaggaggattggatagcaagccggaaaggcgaagggaaggagaaagggttgggcatcctgccctacgggtcaggacgcccaaccagctcgaaaatcaaatcaggcgaagctggcgataatgagcagcaaccggtccacgagagtggccaccgccctcgcctgctcaaccgcctcggccgccgcatcgaggtcgctcagccgcttcttcaacgtcgtcgtcgccgttttcaactcgccgacagcctgctccacttccggtgtccggttggcaatcgccacctgccccagacggcgggccgcagaccgtatctccatcgcctcgtcggtagagccgggttccttgctgatgaaaagacggccggaacactcgtaaagagcggcgaccacctcatcgatatccttgtctgccatgtccctctcctcttcgctcccagatcgagatcattcgcatgcgctatttccggacttgcccgatggctttattcaggtcctcggcccggctgatgaaaacatccacggcggcgaccacgtcggcatatttcttgggatcgcgcttggatcgggcaaagcttgccagttccgacacggcggccttgaacccgccgatggattgggaatagctggtgcggatcgtccgcaactcgtaatacgccgaggccttacccttcacgatcgccagaagggcttgccgatcggccatcttggccggcaacaggtcgttgtaggcttccacggcaaaaccgtattggccggtcgccccatcgcccatgtccgccaggacgattgccatgtccttatccatgttgtctgccaggcggcctatgggttgctccgccgacagaatggcttcgatcagggcatcggcctgcttctgctcgatgaccatcttgccgatggtccccaccaggatcgcgatgggaccggatgcctgctccagctccttcagatttccgcccttaccggtcatcttcgccacatcgcttccgaccgtattcacctgctgctgaagcgatgtcacggccgacgcgaagtcggctcccggcgtcgccgcgcaggccttggaaagggcggcggcataggccttgagggtggacagggcactcttgcgcgccgccatgtccgccggagtgagcaacgaagtgttgattacgcggccatccaggggacaggcccccctcgtccgggcttgggtcccgcaacggccatattccgaccgcgccacctcgagatcgaattgcgtgcggtcgctcgcgaccaagaaggctctcggtacgatccgcaaaattggtggcggcactcgaaaacttcgccaagtcggatgtgaactggtcaggttgggcacaccccaccaagacggccgccatggcgacggcaattacacgattgggccagatcattctcgcctccgttaaagtcaagacacagccgagtcgaccatcaatgcgcaaccaatcgaaattagcgcaggagtccataactccttcgcacacactcgtcacaatacgctacatttattgatggtctatgtgaagtatagcattctttatggtagaattaaatagcttctacaccccttcagcctgcctgttcacgaaattgggggcggaccggcaagaagcgaggcggccgatcgggaattgccgccccaccggatacacttccatacaaatccgacatacaggggttaccgcccggccctaacctgaatccattcatcgttgagcacgagggcatcatgaactatttcgacaacggcctgcgccgctacgccacccaggccaccgccgttctgtccgtggtggtggggattacgggagtgatcctgttctttcatctggccaaggacccggtcgaggccatccatgaatggctgggcatgggctttgccgccgtggcgattctgcatgtgatccgccatcgggggtcgttcgccctgatgctgcgtcagcgccaattgcacattctggcggccatcaccgccttgggcgtggcggctttcgtcgccctggtaccgccaaagccatcgggcaatcccatggcccgcctggcccgagcggccgagcaggcccccatttcccagttggcgccggtgatgggcagccgcaccgaggatgtcctggcccgcctacgtcaggccggtatcaatgccgagcccggcgacagcctcgccgccctggcggccagccaccatgtggagtcggtcaagctgatcgccctggcgcttccgccctccaagcggccaaactgatgggcgttttcaccccgttgccgttacaaatcggaatagtttcgccttagactccaccaaactcaccagttctactctgcatggctgttgttatgcgcggcatgatttcaaacaggaggggcagcacgtgggcactcagacgatcaatctcgccgatttcattcaggacgccagccagaccggagcggtcaggtgccggtggacggagacaccttctacctgatcagccagcggcgggctgcgctatgcgatgtcgccgcagaccaagctgatggacagcggctatgtgggctatcagcatgtgggggacctgcgcctgctgaccggcggcgacggcaccgccaaactcaagaccggcaccgccgcggcactgacccgggccaagtgcatgctggcggacaacctgatgaagccccaggcgtggttccgcttgcccaagatcgccgacgaccaccgcatgagccactacgtccccaagctgcgccagatcgccaaggagcggaaccaggcgtaaggtcgttcgggagtaaaaaagccccgcttcgcggcagggctaccgccctgacccgttcggaggcacagcctccgaacctccagcttccttttatttctatggactaaaaagcagaagggtccgggaagcctggcttccaggttgggggatcgggggcaaaagcccccgaagtgacgtccatccgcagcctgctaagccccgctccgcatggcggtccagatggccagggcttgggccgtctcgggcacgtcgtggacgcgcagcacctgaaacccggcatccagaccggccagattggccgccaaggtgccgggcagccgggccgtcgcaacctcgtcccggctcagccgggccacgaagctcttgcgcgacactcccagcagcagcggcagccccagaccgtgcagcagagccagactccccagcacctgggcacaatgcccgggcgtcttgccaaagccgataccaggatcgaggcagatccgctgacgggcaatgcccaggcttcgcagtcctggacccgtcgggccagatggtcgaacacgtcgagtggcgcgcaggcatagcggggctccgcctgcatggtgcgcgggtcgtcgccctgcatgtgcatcaggcaaagatcggcgccgcttcgggccgccaccttgggagactcgggatcgccgagcagggcggtgacgtcgttgatgatccgcgcccccgcctcgaccgccgcgtccatcacggcggcatggcgggtgtcgatggagacgcacaggcccttttcggccagggcgcgcaccacgggaagcacgcgccgcgcctcctccgccgggctgaccggatcggcgccgggccgggtggattcgccgcccaggtcgatgatggtcgcccccgcctcggccagggccaagccgcgtgcgatggcggccgtgctgtcgaagacctcgccaccatcggagaagctgtcgggagtgacgttgacgatgcccatgatgcgcggccggtccagctccagcccgccccagggcttgcgccggcttcccatggcgtggacggtctcggccacctgacgagcgagggccgggtcctcgccctcggcccagtccaccacctcggcgaaggaggccacggccagatcggccccgcccccaggacggcgggtcgccacgcccagggcggtgaaggcggcccagccgtcggccagaggccagccattgccggaaatcaccgccgccgccgcctgctcgccccacaccagaccggtgggcagcaggtagagcccgcccgccgatacgtcgaagccccgcggcaaagcggggcttcgggtaaaggccgatgtgatccctgcctcaggcaccgggctgcggctccggatcatagccggggcggttgccgggaccggagctgggcaccgaggagcggcgcggcgggtccttggggcggtagtcgccgttgtcgccgcggctgatgggctcgccacggatcagggcgtcgatatcctcgcgggacagggtctccagttccagcaggcccttggcgatgatctccagttcggcgcggtacttggccaggatttcgcgggcggtgttctcgccctcctcgacgaagcgccgcacctcggaatcgatcaggctggcggtggcttccgagatatcttgtgctgggtcaccgaatgacccaggaagatctcttcctgattgtcgttgtagcgcagcggccccagcttctcggaaaagccgtactcggtcaccagcttgcgcgacagatcggtggcgcgctggatgtcgttggaggcgccggtggtcaccgcgtccaggccgaagatcatctcttccgccacgcggccgccgaagaacgaggcgatcatcgccttgatctgcttgagcgacagggaatagcggtcgcgttcgggcagagacatggtcaggcccagggcccggccacggggaatgatggtcaccttgtgcagcggctcgtgaccgggcacgtgcatcatcaccaaagcgtggccggcttcgtgataggcggtaagcttcttctcgtcctcgctcatcaccatggagcggcgctcggcgcccatcatcaccttgtccttggcggcctcgaactcggccatggtcaccacgcgcttgccggcgcgggccgccagcagggccgcctcgttgaccagattggccagatcggcgccggaaaagccgggggtgccgcgggcgatgatgcgggcgtccacgtcgggggacagcggcaccttgcgcatatggaccttgatgatcttctcgcggcccaggatgtcgggattgggcaccaccacctggcggtcgaagcggccgggacgcagcaaggcggggtccagcacgtcggggcggttggtggcggcgatcaggatgacgccttcgttggattcgaagccgtccatctccaccagcaactggttcagggtctgctcgcgctcgtcattgccgccgccgagaccggcgccgcgatgacggccgaccgcgtcgatctcgtcgatgaagatgatgcagggggcattcttcttgccctgctcgaacatgtcgcggacacgcgacgcgccgacacccacgaacatctcgacgaagtcggagcccgagatggtgaagaacggcacattggcctcgccggcgatggcgcgggccagcagggtcttgccggtgccgggcgggccgaccagcaggcagcccttggggatctttccccctaagcgctggaacttctgcgggtccttgaggaactcgacgatttcctcaagctcctgcttggcctcgtcgatgccggccacatcctcgaaggtgatgcggccggtcttttcggtcagcaggcgggcgcgggacttgccgaagcccatggccttgccgccgccgccctgcatctggcgcatgaagaacacccacacgccgatcagcagcagcatggggaaccacgacaccagcacgctccagatggtcggagcatcgtccgagggcggcaccgccgtgatgcgcacggaatgggcgcgcagcttgtcgacgatattgacgtcctggggcatgtaggtggtgaagggacggccatcggtgaagtggccgttgaccacgctgccctggatggtcacgtcggcgatagcgccgcgatccacgtcggagaggaattcggaataggaggtctggcccggaccgcgcggcggcgaggacgcctggaacagattgaagagcatcaccagcaacacggcgatgatgacccacaacgccaggttcttgctaaaattcaaggtagcgtccttcccgtcaagtgctgtaccggacaacgtcgtctacagataatgccgattcccgccggcacaagcgaaaacggtcagaacatggagcggcgaagcgcgcaagctcaccaggacccgaccggcaccctcccggttatagccgaggtgcggcgccgcgagaataccccgctcatggtaaagggccggtaaagtgggaatggcgcaggtgggaaccggttcgggccgctgccgtcccatggccgccagcaccttgcgccgcccttcgggccccagcgcccccaggcgcaagcccggcggcgcgtccccggccaccaccgcctcgaagcgcccatcccagcggatgcggcttcccggaaccagatccagcggcggcgccacccgggcgggctcacggcacagcaccacggaatcgccctggggcacgatgcggcagcccgccagggtccgcgccgcctccaatcctccgcacagcgtggcgtgaaggcgttccagccgttccaggcgcggcgtatgggcctcgccgcccacgctcagcagcaggccggccagcaggcgcagccccacctcgtcgggcaatccggccagggcctcggggcgcagccggccgaagccggcggggtccagggtcacatgccgggcggcggcctcggccaccatggaatcgacggccgcctgggcccgggccagccgcccggcggtctcggccagccggcgtggcgtcatcccctcggcggccagatccccagccagatggcgcagccgcacccgggcgaaggcggggttgcggttggagggatcgctggtccactcctgccccctgtgccgcagggtggcttccagacggacacgcggcacgggcaacagcgggcgcagcaggcgcccccaggaggtcggacgctcggccgccatggcccccagcccttccagccccgacccccggccgaggcgcagcagcagcgtctccgcctgatcatcctgatgatgggccagggccagatgcagaatgccctcggcggcgcaggcctcgcccagcaggccatagcgcgccgcgcgggccgccgcctgaagatcggcggcgggcttgtcaccctcccaggcgagaatgcggtgagagatgccgtcacgggccagccacgcccccacccgggccgcctcggcggcggattcggggcgcagacggtgatcgacggtcaaggccagaacctcgccgccccgcgccttcgcccaatccgccgccagcagggccagggccagggaatcggcgccgcccgacaccgccaccgccagacgcggtgcggcctcgaacggccccaggggcgccatcaggcgggagaagtcgtcggaggaaagcggcggaacggacatgggttctggtgtccccgacctgtcgggcactcgcccgaacccatccggggccaatgccccggaccccattttatttcaggaatggggtttggggtccaaggccccaagcgggttcgggcggcagcccgatatcccccctatttgccgcagcccaaacgctgcttgtccccggtggcggcgcgcttgatgcggtcggccatgtcgggatgctcggcgaacagcagggcataggtgcggcacgcctgatccttcatgtccaggtggccgaacgaagcgcccagcttgtacagcatgtcgggagccttggtgtgcttggggtacttcttgtaggcctcgccgaatagcttggccgaggtggcgaagtccttgcgctgggagaaggcgatgtcgcccagccagtactgggcgttgccggccagctgatggttgggataggtcttgaggaaggaccggaatccctgctcggccccgtcgtaatcgcccttctgggccagaccataggcctcctcataggcggactgggcgtccttgggggcggcaggcggcgccttggcggcctgggcctgcgcctcggcctcgcccttcttcaaggcaccggcgggcatggcgcccagattctgcgggcccggcgccgggccgtcattgtcggcggagttggcccctggcttgacgcccttgggcggaatcagcaccggcgcgccgctgggcgtggtggccggggccgaagccgccggcatggacatggattgcggctgggcggacgaggacgagccgcccttgcccccctccagatccttgaagcgcagatcgatatcggcctgcatgcgctccagctgcttgttcaactgggccgccttgaaattggcttcctcgatcttgccggtgaggaagcggttggcgtcctccagctcgttgatccggtcctccaggcgcgacgcggcgctgcccgagacgctgccgtcattggcggacgagcgcaccacggtggagccgccccgcgccgactgggactggagcgtcatcaggtcgcgttcaagacgttcgatgcgatcgtaaagagcgcgggtatcgctctgcgccgaagcgggggacacgaaggccgcgccgatcagcagggccgacaaggcggtggaaaggacgaaacggcgcacgaccaacctcatcttcgaaacggatgcggaagaatgactttcccatgggcgcaaggcaagaggcgatcccctgatttcgttcaggccctcgcccggccctactcaagtacggtcacggcccgacggctttgcgcccatgccaagtcattgctaccaaatgccacgggacgctccttgccccacgaaattatcttgagcctggcctgagccacaccttgggcgatcagaaatctttttaccgcgtgggcgcggcggtcaccgagaccaagattgtattcgcgagtgccgcgctcatcggcgtgcccctcgacggtcaattggtaattggggtaggccctcaaccagactgcctgcctggtcagggtggcgagggcatctgaacgaagagccgagctgttcgtatcgaaaaagacccggtcaccgatattagtgacaaaatcaccaggcgaaccaggcagatacctggtgtccggaagtgctggcggcgtgccgacacaggccaccgacatggactggggggccgattcacaggcggcaaccagcagaagcagcgcgatcactgccacattattcctgatcaaagccattctccccaccctgatgagtgagaaagcatcaagcacgattcaggcaaaaataaggcgcccgcccctgccgaagcagggggcgggcgccccattcttttcgtccgtaaacggcctgattagttcaggacggtcacgccacgacggttctgcgaccaggcggcctcgttcgagcccagagcgacggggcgctccttgccgtaggagacggtcttgacgcgagcggcggcaatgccggcagacttcaggtaggaagccacggcgttggcacgcttctcgcccagagccaggttgtactcacgggtgccgcgctcgtcggcatgaccttcgacggtcagcgagtagttcggataggccttcagccaggcagcctgcttgtccagggtggccttggcgtcagcgcggaggctggacttgtcgaagtcgaagaacacacggtcaccgacgttggcgacgaagtcttccttcgagcccttgacgataccggagctgacggccggagtggtctggccagtgccacccgtgttaccggtgtcagaaggagcggattcgcaagcggccagcagagcggcggcggcaacgatggtcaggaaacgcagtttcatatttgaggactccccctcaatgcgacgcgggaatggaataagatcggaccttagagactacgcgccgcccaatcaaggacgacacgccccaccagtgacatcgttagcgatcggacccgatgtcaccggattaaatcctaatcggcgcggactatacaaagataattctagggaatcaagggggaccacgcgggatccgagccgtcgacgggcgtcagcagcactctttcattcacgccggtcagatcgatggtgtaaaggcgcaccacctggccccgaccgcgctcatccgaaggagattcccggaagaaggacagaacccggccgttgggcgcccaggtggggccttccaccaggaagccctcggccagcaggcgctcgcccgagccgtcggtgcgcatgacacctatgaagaattgcccacccttctgcttggtgaaagcaatgagatcgccgcgcgggctccataccggggtgccgtagcggccgtcgccgaagctgatgcgctgcgggttcgagccgtcggcactcatggtgtagatctgctgcccgccgccacgatcagattcgaagacgatctgctggccgtcgggcgaatagctgggtgccgtgtcgatggccgggttcatggtcagctggcgcttctggcgcgtcagcaggttcatctcgtaaatttcggtgttgccgttctcggccatgctgaagacgaccttgttgccgtctggcgagaagcgcggcgcgaaggtcatgcccgggaaattgcccagcgattcccgccggccggtgtccaggttgaagatgtagacccggggcacgcccttgaaatacgacagataggtgatctcgcgggcgctgggcgagaagcggggcgtcagcaccagttccgagccgtcggtgaggaaccggtggttctcgccatcctggtccatgatggacaggcgcttcttgcggtcgttcttgggaccggattccgcgatatagacgatctgggtgtcgaaatagccgtcctcgccggtcacccgcttgtagatggcgtcggccaccttgtgggacaggcggcgccaatcctggggcgaggcggacagcgtccagccggtcatataggcttcgttgaacacgtcccacaggcggaactccacccggacacggccgtcggcgccgctttcgatcttgccgctgaccagggcctcggcattgatggccttccagtcggggaagcgcggtccggcctgcaaggacgcggcgttctggatgaaggccttgggatcgatgggcttgaacaggcccgaccgttcgagatcggcggagaccacccgggcgatgtcggcgcccatgcggttgtcctgggccgacgcaccggcgaaatcgggaatggcgatgggcagcggcttcatctggccgcgggtgatgtcgatccgcacctcggcctgggcgggcaagaccgccgcaaccccgaggatgacgaagacggcgaacgccgcgagcgagcgaatgcgtgacatggtgatcatctccctgccgcaaacttggggttgaaggccaaagtgaaatccctgaactggtcgtacttgtccaccggaatgggcagcgggctggcggcgcgcacggcgcggcgcgcgctgtcggcggcggcctggtaataggggttcatcatcattaccgggttcagttcgacctcggcggcggtgaccgtgccgtcaggcagcaccgagaccttgatcatcaccaccagcttgtcggcgtccttggctccggccggcacgttccagaaccgctcgatatgagcgcggatgcggtcgcgctcggtcatggagaccggctcgttggggttatgcgacgccgaaccgcgcaccgattgcggcgcggtctgggtggcggtcttgttttccggcaccgagggcttgagcttctcggtggacttcagaagcttatccaattcgtccttgggcgtcggcttcttcttgtccaccgacttgagcagcgaatccagctcgtccttgacgtccttgggcttcttgggcggctcggggcgcggctcgggcttgggcggcggaggcggctccggcttgggctcgggcttgggctcgggcttgggaatgggcgcgggcgccggctccggcttgggcggagggggcgcgggcgtgggaggcggcggcggcgctggagtgggcggcggcggcggcttgggcggctctggcttcggcggctcgggcttgggcggttccggcttggggggctcgggctcggccttctggggctcgggctgcggcttgttgtcctgcaagggcggcggattggtcttggccccgatggggacgatgtcgacgacgatgggcgcctcttccatgggaatctcgcgccagaactgcggcaggccgaacaccgccagcaggaacagcgccagatgcaacaggccggagaagacgtagctttcgcgccgcaattccatgatccgagcctagcgcccccccttcttgaccggcttggccggctcggagcccttgacctcggtgaccagggcgaccttggcgaagccggcggcgccgagcgtacccatcacctccatcacccggccgtaatcgatgcccttgtcgccgcgcacgaagatgcgggtctcgggcttctgggcggtgatggcctgcagccggggagccagttcatcgatctggacctcggtttcctgaatccagatcttgccatgggcgtcgatggtcaccgacagcggctggtcgtcgcccttcagaggcgccgacgaggtcttgggcaggtccacctgcacgccggcggtcagcaagggagcggtgaccatgaagatcaccagcagcaccagcatgacgtcgaccatgggggtgacgttgatctcggccaccggccggaacttgcgggagtgccccttgcggttccccagcgaggcgcccatcaggccttctcctcgagctggcgcgacaggatggcgccgaattcaccggcgaagttctccagacgcttggaatagcggtccaggtcggtggagatcttgttgtaggcgatcaccgccggaatggcggccaccaggcccagcgcggtggcgaacagcgcctcggcgatgcccggcgccaccacggccagcgaggtgttcttggtcgcggcgatggactggaacgagttcatgatgccccacaccgtgccgaacaggccgatgaacggcgccgtcgagcccaccgaggccaggaagcccaggcgacgctccagcaattccatctcgcggcccagggtgacgctcatcacccggtcgatgcgctggggcaggctagcccgggtggaatcgcggtcggccaggcccttggcggccgaacggcgccattcgcgcatggcggccacgaagatggacgacatggggtccagcgggcgcgagccgatgcggtcgtacagctcttccagcgagccgccggaccagaaggcctcctcgaactggtcggcccgcgtggtcagctggcgaaccttcatcagcttgtcgaagatgatggcccagcaccagaacgatgccatgagcaaggcgatcatgacgaatttgacaatgatatcggcgcgcagaaacagcgcccacatggacaaatccatctgcgccgccgctccggccgcccctactgcctgagaaggatccataatacctaccgcctttcgctgatccgattcgcgaacaaatccctgaccggcgccggaatgcgggccggcttgcccgacagggtgatatagcccaggcgcacctccaggtgcaccaattcagttccgtcgtccacccgaacgattcgctggtccagttctatactggcaccgccgatggaaatcacctgggtttccaccgacagcagatcgtccagcttggccgggcgacgaaaatccagattggccgagcgcaccgcgaaggcggttccctcaccatcctccagcatggcccgctggctgatgcccagctcgcgcaccatttcggtgcgcgcccgctcggcgaatttcagatagttggagtggtacacgatgccgccggcatcggtgtcctcgtaatagacgcggacggggaaggtatgggcgttcacggcaaccagcctcccgcccaacctgtcatcccgagcgcatgcgagggatctccgcctggaacgatgatgccgaccccgacatggcggagcaggatgagatccctcctcccgttggtcgtcgggatgactgtcgccatcaccatcattccccctcctcatccatgcgggtcagcaggtcgagctgcaccagcagatccttggggggattgaggccgatatgcttgaagccggaggccgacagcatgcggccacgcggcgtgcgctggatcatgccctgctgcagcagatagggctcgaccacctcttccagggtgtcgcggctttccgacagcgcggcggccagggtttccacccccaccggcccgccgccgtaattctcggcgatgcagcgcagatagcggcgatccatggcatccaggccgatgcggtccacctccagccggttcaaggcggcatcggccaccagggcgtccaccggcgagcgcccggccacgacggcgaagtcgcgcacccggcgcagcagacgcccagcgacgcggggcgtgccccgggagcggcgagccacctcggcggcgccatcgggggtcagggcgaagcccagcacacgggcgccacgcgacacgatggcctccagctcggccggctcgtagaaattcatgcggcagggaatgccgaagcgttcccgcagtggcgtggtcagcagccccgaacgggtggtcgcccccaccagggtgaaggggggaagctcgatgcggaccgaacgggccgccggaccttcgccgatgatcagatccaactgaaaatcctccatcgcaggatagagaacttcctctatggcaggattaaggcgatggatctcgtcgatgaacagaacgtcacggggctcgagattggtcagcaaggcggccagatcgcccgcccgctggatcaccggacccgaggtggcgcgaaagcctactcccagttcgcgagccatgatctgcgccagagtggtcttgcccaggccgggcgggccgtggaacagcacgtgatccagagcctcgccccgcgccctggcggcgctgatgaacaccttcaggttctcgcacacctggcgctggccgacgaaatcgtccagcgactgcggccgcagcgacatctcggcatcattggggttctgctcgggcgagaccacgcgggaggtcatgtcacatgcccctcaatcgccgggcgctcacctgcggctcgcttggctttcgcggcataagccgcgccggcccttggccgcaactcctcgcggcgctcgtcggtcacatgcccctcaatcgccggaaacgcagagccgacggactcgggctgccgcccgggcccgcatggggcgatgccccatacccccttcactttcaagccaagggtgggacggggaggcatggcctcccggtcggggaccggggcggaagccccgaggatggcggatgcctgccgcctcatcccagcagccccttgcccaggtgcttcagggcggcgcggatcagggcggacgagtccgcctcgtcccccagctcgcgggcggtctcgcccaccgcctggaaggcctccaggcgcttgtagcccagattgaccagggcggagacggcgtcctccatgcggcccgaggcggcgggcagcggcgccgaagccgacagcgcgtccttgatcccaccgggagagaagccccccagggcgatcttgccggccttgtccttcaactcggtgaggatacgcaccgccagtttcggcccgacgccgttggcccgggtcagcccggccttgtcctgggccgcgatgatctgcagcagctggtccggcgaggccaccgacagaatggccagggctaccttggccccaaccccctgcaccgtggtcagcagccggaaccagtcgcgctcgccggtttccaaaaagccgaacagcgagatggcgtcttcccgcacctgggtctcgacgaacagggcggcggcggtgccggtctccagccgcgccagggtcttggacgagcaggccaccagatagccgacgccgttgcaatccaccacggcccagtcgtcgccgagggaatcgatcaggcccttcagcttggcgatcatcgcgccaccgcccgcgccagcttctgctgcgtgccccggtgatgggcgtggcagatggccaccgccagggcatcggcggcatcggccgtggcggccaaacagccgggcagcaaggtcttgaccatcatgcccacctgttccttggcggcgcgcccggttcccaccaccgattgcttgaccagggtggcggcgtattcgcccaccggcaggccggatttggcgggaaccagcagcaccacgccccgggcctggcccagcttcagggtgctggcggggttcatgttgacgaaagtctcctccaccgccgcctcgtcgggggagaaatcggcgatcaccgccatgatgccgtcatggagctgaaccaggcgctcggccaaagcggcggaggcatcgggacggatcactccgtcggccacatggcgcagacggttgtcgaccgcatcgatgatgccccagccggtattgcgcaacccaggatcaagccccaggattctcatcagccgagcttttccatgatgtcgtcggggatctcgaaattggcctggacccgctggacgtcgtcgttgtcctccagggtgtccagcagtttcagcagggtccgggcggtctcctcgtcggccaccggcaccgtggtctggggcttccagtcgagacgggcgtattccggcgtgccgaacttggcttccagggcgtcgcgcaccgcgcccaggtcgtcgggggcgcacgtgatctcgtggccgtcctcgtcggattccacattgtccgcaccggcgtcgagcgccccttcgaacatggcctcggccccggcggcggaggccgggtagcggatggcgcccacccggtcgaacatgaacgacacggaattggtctcgcccagcgcgccgccgttcttgttgaaggcggtccgcacctcggtggcggtgcgattgcggttgtcggtcaggccctcgacgatgatggccaccgagccggggccatagccctcgtaacgcacttcctcgtaattggtgccgtcctcgccgccggcaccgcgcttgatggcgcggtccatggtgtccttggacatgttggcggcgcgggcggcgacgatggcggcgcgcaggcgtggattggccgccgggtcaggcatgccggatttggccgaaaccgtcagttcgcggatcagcttggtgaagaccttggcacgcttggcgtcctgcgcgcccttgcgatgcatgatgttcttgaactgtgaatgcccggccattttccgccaccaaatcccgatgaaatgaagatcgaccggtgcctataccacatgttgtggcaaagcaacaggcatcacgccgccaacgcggcatgtctcccgggatcggctcgaaaaaaagcgaggatcagcggccggcggccgggaccatggcgatcttcttgcgcatggcgtcaagcagcacgtcgagattgccgcccgcccccctgaccacggaggtgaagtcagagcggatggtggtgaccagccccaccccctcggcgatggcgtcggaaatcaccagcttgcccgccgggctgcgcgagatgacgaaggacaggtcgacgccctcctcggccggttgcatgatgcgggccttgaccaccacgccatcggccatctcctcgctgcccagaaacaacacctgggtcgagcccgacttgttgtcgatcagctcggcataggtggcgacgaagaacgggatcagcagagagacgaagctatccttctgcggctcggtcgccttgcgccagtagcggccgagaatcagttcggattcataggcgatgtcgccgtatttggacaccagggcggagaccttgtcgcggctgacctcgcggctaaacggcccgccggcaaaggccgccgtcgcatccgcgacggcctgcttgaccagggcctcggccgccgggccatcgcccgcccgggccggctgaaccaccagaagcaaggacacgaccagcaaacccatcagacgcagcatgatcatcgtccctcctcatgttcggcaaaacggtgccggaccatatagacatccccctgaccgaaagctttcaccagtcgggccaacactccgccaggcgtccgcccaggcgcagcggcgcgacgcgccgggccaggccggtgcggtcgtcggtttccaccatcaccgcgcacagggtccccggcccctcggccggcgacaggcgctcgcccgggatcttgcgcacgaacttgaagatggcggcatccttcttcatgccgatcaccgaatcatagtcgccgcacatgcccgcgtcggtctggtaggcggtgcccttggccaggatctggcaatcggcggtcggcacgtgggaatggctgcccaccaccagactggcccgcccgtccgagaggtgccccagcgccatcttctcgctggacgcctcggcgtggacatcaacgatgatggcatcgacgccgccggcgcccatgcgggccttggccagcacggagtccagcgcggtgaaggggtcgtccagagggtccatgaacagccggcccatgacctgaaccaccatcaccttgcgcccgcggggacccgcaaagaccccggttccgtgacccggcgtgccggaagggtagttgagcggccgcagcacgcgggcctcgccatccaggaaggggatgatctcgcgctggtcccaggtgtggttgcccagggtcaccacatccaccccgacggcgaaaaaatcctcgcagatcttgggcgtgatgccgaagccgtgggcggcgttctcgccattgacgacgatgaagtcgggggaaaggcggttcttgatctcggccatgcgcccgacgatcacgtcgcggcccgaacggccgaccacgtcacccatgtacagaagtctcatttagcggccgtcacgatcacgccatgctccgtggctatgagatccaaagcgatatcccaggggtcggtgggaacagtgtccacctcctgggcggcgaaggccagcccgatggcgcacaccgcgccatcccggcgcaactggcccaaggtccggtcatagtagccgccgccatagcccagacggaacccccttgtatcgaaggccagtagcggcaccagcaggacttgcggaccgacgggggggcgggcgacggggtgccatgtgccgtgggggccgggctccagcgcctctccggggctccacgggcggaattccaggatgccgccgctttgggtcacggtgggcagggccagtacatggccgcgcgccgccagcgcatccatcaggggccgcgggtcaatctcgtcgcccagcggccaataccccgctaccaccattgcaggggccagtcccagggcatcggccagccccgccagggcccgggccgcggccgggccgcgcaccgccgcctcacgccgcgtgtggcgggcgatccgtcgcaattccatcttgctgggcgcgggggaaatctcggtcatggcatcagtggagcggcgccgcctcggccgttggcctgcaagtcctccgtggcctgcttacgcaggtgggtggccatataccggaaccagggctccggcagggacagcccccgagaggaagatattggccccagggacgttggctgcctgacgcaccgcgcagcagaccgctccatccctgaagctaggccctttccaggcgcatcgcaatggcttcgatgcggcgcgtcagcgaatcgatcagcccggccagcttggtgtcgccctcggcggcggcgcccacctcggtgccgatcttggacagctcctcccgggcctcggccagttcgtcggccagcagcaggccgaccatgaccagcaggcgggtatcgctgaccgcccccaccgaggacagcaggtgctgggcacgggcatccacctcgcgccccaggacgtggacccgggccacctgggaatcgtcgcaggcgatgtcgtagacccggccgttgatggtgacgttgacgacagccacggctcagtcctccagcaggtcgcgcaagcggtcgatagtggcgtccaggcgggtggagaccacgcgggtggtttcctccagcttggcgtaatcgtcgcgggcgccgcgcagctcgccggccagcagcagatcgccggcccccacccgggccgaagcggattcgagacggtcgatggcggcgcccaggcggcgcatggcctcttcggtgcgttgcaagctctgcccctgacgctgttccacgatccatccccatgttccggaatcgacgtcgaaggtatggccgaagggcaaaggagtcaacaaaggctgggttgatcggggccaagccagacgataccctcttccaacctgattctcatgaaggatggaatccatgcgctccgccctgaaggccgccctgttcgccgccgcgattctcgcctccccggcggtcatgtcttcggcggcccaggcggagccgccgctgccactgtccaagggccagaccctctacgtgccggtctattcccacatctcccacggcaatctcgacggacggagcaagccgtccgaactgctgctgtcctccatgctcagcctgcgcaatgccgaccccagccaccccatcaccatcagggcggcacgctattacgacaccgacggcaagatgctgcgcgactacctgaccaagccgctgaccctggcccccatgggatcgagcgagctgttcgtggaacacagggacaagagcggcggcagcggagccaatttcgtggtggagtggacatccgaccgaccggtcaacccaccggtcatcgagacggtcaacgcctatttcttcggcacccagtcggtggccttcaccagccccggccgccccatctcgcccaatccgtgacgccggtcaccgtccagtccctggatcaggcccgcaccgcgctgcgggctgccgatcctgaccgaccggtcagactgcaaagcccccccggcgccgccgggcagcacggaatcggctggtggctggccctgacccgtcttctggccgaggagtttccccagcgggaaatggaggcggtgctggattgcggcgatgccccgggggcggttctggcggcgcttcgggccggcgtgccgctggtccgggccagcggtctgcccgacgagatgcgggacaggctggccgacattgcccggcggatgggagcgcgattgctggcctgaacgccggcgattcgggatacgtcaagaaaatgcgggggcgggcctgtgccgggcccgcccccgccagtcagcggcctcagggagactggagggccgcggtgaattccggcaacaccttgaagagatccgcgaccaggccgtaatcggcgacctggaagatgggggcctcttcgtccttgttgatggcgacgatgaccttggaatccttcatgccggccaggtgctggatggcgcccgagatgccgacggcgatgtagaggtcgggcgcgacgatcttgccggtctggcccacctggaagtcgttgggcacgaagccggcgtccacggcggcgcgcgaggcaccgactgcggcgcccagcttgtcggccacggcttccagcaggtggaagttgtcgcccgactgcatgccgcgaccgcccgagatgatgatccgggccgaggtcagttccggacgctcggacttggacagctggctgccgacgaaggacgacagggccggatcggcggcggccgacacggcttccacggcggcggagccgccctcggccttggcggcctcgaagccggtgccgcgcacggtgatcaccttgaccgcgtccttggactgcacggtggccagggcgttgccggcatagatcggccgcacgaaggtatcgggcgacaccacggcggtgatctcggagatctgcgccacgtccagcagggcggcgacgcggggcgccacgttcttgccccccgtggtggccggggccaggatgtgggaataggacccggcaagactcaccaccagggcggccagcggctcggccagatggttggcgtaaagggcggcgtcggccgacagcaccttggcgacgcccgccaccttggcggcggcctcggccaccgcgccgatgcccgagccggccaccagcacatgcacgtcgccgccgatcttggaagcggcggaaacggtgttcagcgtggcggatttgagagcgccgccttcatgttccgcgataaccagaatggtcatgtcttttcgttccttgtcctggccacgtcggggcttccgccccgcaccccgaccggggaagaccccggaccccttttgaattcaaggggggtttggggcatcgccccaaatgggtccgggcaatcgcccggtcgtgccgtcagatcaccttggcttcgttcttcagcttgtcgaccagggcggccacgtcggccaccttgatgccggcgctgcgcttgggcggctcggccaccgacagcgtcactaggcgcggcgccacgtcgacgcccagatcggccggcgacaccgtgtcgatgggcttcttcttggccttcatgatgttgggcagcgaggcatagcgcggctcgttgaggcgcaggtcggtggtcaccaccgccggcagcttcagcgacaccgtctccagcccgccgtccacctcgcgggtgacggtgatggcatcggcgccgatctccaccttgctggcgaaggtgccctgggcacagcccagcagcgccgccagcatctggccggtctggttggaatcgtcgtcgatggcctgcttgcccaggatgatcagcccgggagcctccttggccaccagcgccttcaagaccttggccacgcccaggggctggacctcgtcatcggtctggaccagcacgccacggtcggcgcccatggccagcgccgtgcgcagcgtctccgacgcggcggccgggccgatggagaccaccaccacttccgtggccttgcccgcttccttgaggcgaaccgcctcctcaaccgcgatctcgtcgaacgggttcatggagaacttcacgttctgggtctcgacgcccgaaccgtccgacttcacccgaatcttcacgttgtaatcgatcacacgcttgatcgcgaccaacaccttcatgactgcatcaccctcttgaagttcggccgggcatcgctgcccggccggtatcgtggcttcaggttcaggagaacgcctggatgccggtcatggcccgacccaggatcagggcatggacgtcgtgggcaccttcgtaggtgttcacggtctccagattcaccatgtggcggatgacgtggaactcttccgagatgccgttgccgccgtgcatgtcgcgggccatgcgggcgatgtccagcgccttgccgcagttgttgcgcttgatcagcgacacggcctcgggcgcccaggtgtggtcgtccatcatgcggccgacgcgcacgcaggcctgcaggcccagggtgatctcggtcatcatgttggccagcttcagctgggggatctggttggcggccagggggcggccgaactgcttgcggtccagcatgtactggcgcgccgcgtgccagcagaactcggcggcgccgatgacgccccaggcgatgccgtagcgggccttgttgaggcagccgaacggaccacccaggccggacgcgttgggcatcagcgcctcgtcggggacgaaagcctcgtccaacacgatctcgccggtgatggaggcacgcaaggagagcttgccctcgatcttcggcgtggtgaagcccttgatacccttctcgacgatgaagcccttgatcttgccctcatgggcgtcggacttggcccagacgatggcgatgtccgagatgggggaattggtgatccacatcttggaaccggtcagcagatagccgccgtccaccttcttggcgcgggtgcgcatgccgcccggatcggagccggcgtcgggctcggtcaggccgaaacagccgatgatctcgccggtggccagacggggcagatacttcttcttctgctcctcggtgccgtagctgaagatggggtgcatcaccagcgacgactgcacgctcatggccgagcgatagccggaatccacccgctccacttcgcgggagatcaggccgtaggccacgtggttgacgcccggcccgccgtattcctcggggatggtggggccaagcaggcccatctcgcccatctcgttcatgatctcgcggtcgaaggtctcgtcgcggaacgccttcatcacgcgcggctgaagcttctcctggcaataggcgtgcgccgagtcgcggatcagcttctcgtcttcggaaagctggtcttccaggagaaaggggtcgtcccacttgaaatgctgcacggtatgtctcccatacgatgatgaatggcactgggcgcaccatggcccatgggagccattatgagaaaaatatcttttctatggatgtcataacgtttcattatatgtccgtcattcgtcccgccgaatgacggcaaggccaagggccgccgcggcttatgccgcgagagccaagtccgccggaggtggacgcccggcgactgagggcatgcagaaccatggatatccgccagctccgctatttcttaggcatcgtcgaacacggctcgctgaccaaggcggccgaggcgctgcacgtggcccagccggcgctgagcctgcacctgaagcggctggaggaggagttcggctgtccgctggtgcaccgcacggcgcgcggcgtggtgcccaccgagagcggcctgcgcctcgccgtgcgcgccggagtgctggtcgagcgcatggccaacctgaaggacgagatccggggcctggaagcggccccggccggtccggcggtgatcggcattcccacctcgctgggtcccatgctgaccgtgcccctggccctggcggtgcgtcgccttcacccctccatccatctgcgggtggtggagggcctgtccggccacatgctggaatgggtgctgtcgggctcggtggacatggccctggtgttcggctcggaacatccggcgggcctcgccacccgcttcatcgcccgcgagcgcctggccctggtgggccccaaggacgatccgctgctgaatggccgtcgcgacatggacctggcccacgtcctcgccctgccgctgatcctgcccggccgcccccacggggtgcgggccgaggtggaacgggccggacgcgccctggggaccgagcccagcgtggtgatcgagatcgacgccctggaccagatcaaggccctggtcgccgccggggccggctataccgtgctgtccgagcgctatgcccgtttcggcgccgaagcggcgaacctggacgccctgcccatcgtcggcccggaaatcgaacgcaccatctccctggcccacgccctgggacgccccctgtcccttgccgccagggcggtgcacgccatcgccgtggagcatctggatctgttgaccaccgacggccggtggaaatgatacactaaatcttgtttcgagtatcgtttcgtaacgtaatcccgtaaaatggatgtgcattctgcttccggtgaagcccccgacggtgttaggctccagccttttccgcggccaagagagggcaagcccccgcctccgcggatgataccggagagcgtgaggagctgttcatgtccgctgccgttcaggccaagccgcaatcgcggattttgttgtcgggtaacgatgccatcgcccggggcgtgtgggaggccggcgccaaggtggccgccgcctatcccggcaccccctcgaccgagattctggagagcctgtcgctctatcccgatctttacgccgaatggtcggtgaacgagaaggtggccatggaagtggccatcggcggctccatgtcgggggcgcgctcgttctgcgccatgaagcatgtgggtctcaacgtcgcctcggatgccttcatgacggtgaccgtggccggcgtgatcggcggcctggtgatcgccgtggccgacgacgtgggcatgtcgtcctcccagaacgagcaggattcgcgcttctggggccgcttcgcccatgtgccggtgctcgagcccgctgattcccaggaagcctacgagatggccaagtacgccttcgagctgtcggaggcttacaacacgcccgtcatcctgcgtctgaccacccgcgtctgtcacgtcaaggcggtggtgcaggtgggcgagaaggtcgcccacgatatcggcggcttcaagtccgacgcgcgccgctgggtgatgacgcccgccaatgccaagggcctgctgcccgcccagatcgcccgcgaaggcaagctgcaggcgctggccgaggcctcgcccatgaacttcctggacgacggcccggacaagcgggtgggcttcgtcacctcgggccccgcctatatgcatgtgcgcgagagcttccccgacgccccggtgctgaagctgggcttcacctatccggtgcccgtggccctggtggaaaagctggccgcgcaggtggagcatctggtggtggtcgaagagaccgagccgctgatggagcaggagctgaaggccgccggcctgcaggccattcacggcaaggacctgctgccccgtctgggcgagctgactcccaacgtgctgattccggccatcaagaccttcctgggtgagccgctgccgcccaccaccacctaccccaagttcgatcccttcccccggccgccgaccatgtgcgccgcctgtccccatatgggcgtgtattactcgctggcccgcatgcgcaagaacgtccagatctcgggcgatatcggctgctacaccctgggcgccggccatccgtggaacgcgctggacagcaccatctccatgggcgcctccatgggcatcgcgctcggcatggacaaggcccgcacggaagagaccaaggacaaggccgtggtcgcggtgatcggcgattccaccttcctgcacatgggcatgcagggcctgctggacatcgtctacaaccggggcaacgtcaccgtcctgatcctcgacaaccgcaccaccggcatgaccggcggccagaaccatgccggcaccggcaagggactgaagggcgacgacacgccccgcgtcgatttcgccaagctggtcgaggccctgggcgtcaagcccgagcgcatctccaagatcgacccctacgtgctgccggtggtgttcaagaccatcaagcaggaaaccgccatccccgaggtctcggtgatcatcaccgaccggccctgcgtgctgtccgagttctataccaagatcgagccctacaaggtgatcgacgaggattgcaccggctgcggcaactgcatcaacgtgggctgtcccgccatcacggtgaagcgttcggaatccaaggtccgtcccgacggcaaggtcaacgaactgaagttcaccaccatcgacaccgccatgtgcaccggctgccacatgtgcgtggaatcgtgcggccccaaggccatcgtgctggccaagcccgccgcggcggctgagtgaggaaagaagccatgactgacgtcattaccaatatcctcgtctgcggcaccggtggccagggcgtgatgaccgccgccgagatcctgtcccaggccgccatggcccgtggcctggactgcaagaagtcggaagtggccggcatggcccagcgcggcggcgtggtcaccagccacgtgcgcttcggcaagcgggtctggtcgcccgtcatcacgccgggcaccgccgacatcctggtcgccttcgaggtggccgagggctcgcgctgggccgacatgctgcgccccggcggcgtggccatggtcaataccatccgcctggtgccgccggtggtctcggccgggctgttcaagtacccggacgatccggtggcccagatgcgggcggcgggcgtcaccgtctatgatttcgacgccggcgccatcgcccgcgagctgggcgacctgcgcctgatcaacaccatcatgctgggcgccatcgccgattacctgcccttccccgccgccgagctggaagagcagatcgtcggccgcttccgcgagcgcaagcccgccatggtcgaggtcaaccagaaggcgttcgccgccggccgcgatgcggcgggcagcgccaaggccaagacttcggccgcttaagtatttatcgccctttggcattctcaccggcttctgctagcctcaacgaaccggtgagaatgtctcttggcaaaggattgtactgatgtcggctgcggtggatctcggtgcgctgaaggtgctggtcatcgacgaccaggaattcgttcggaccatcgtcaagaagatgctgcagcaggtcggcatcggcgccgtggtcgaggcccatgacggcaattccggcctggaagtcaccgagatggaaaagccggacgtggtgatctgcgacgtgcagatgcgccccatggacggtttcggcttcgtgaaactgctccgcgccctgcccttcggcaagtcgctgccggtggtgatgctgaccgcccacaccgacgcggccaccgtggcccgcgccaaggaactgaacgtcgacgctttcctggccaagccggtcctgccgcccgcgctgaaggaaaagatcatcaaggtgatggccgacgcgcgggggtgacccttccgattttgccgacaaagagctaacgggctgcgacttcgggggcttatgcccccggtcccccaaccgggaagcgcagcttcccgaacccttcagtttattaatccattgagatcgaaaaaagctggtggttcggaggctgtgcctccgaacgggtctgggcggtagccctgccgcgaagcggggttttgccgcagctcaagccctagtacagcccacccgccgaaggtgccggaccggtcggagcctgctgctgctgcggcgcggcgggaatggtgccgtcggggccgggagtgccgggcggcggggtaagctgcacgccgctcgccccctcttccgcccccaggaaaggcgcgaaactgaagccggcatcgatgccgccagagccttccagcacgtcttcctcgtcgccgggcatgcgatcggagcccttgaaggcctcgtaaatggccttggcgtcgccgggcatggccggcttgccggtatgagcgttgacgcgcaccagccgcacgccggacggcacgcggaacggggtgggcggcttgtctttcagcgcttccatcatgaagtcgcggaagatgggggcggcgatggagccgccggtttccttggcgcccagggtgccgggctcgtcgaagccgacgaatacgcccaccgccagatcaggcgagaatcccacgaaccacacgtcgttggaatcgttggaggtgccggtcttgcccgccaggggcttacccaccggcttgaccgaggtgccggtgccgcgctggaccacgccttccaggatcgagaccatctgataggcggagacgggatcgaccatctgctcgcggatgtcgggcagaagcggcatgtcctggccggtgaagcgattggccgagcagccgtcgcagaagcgcaggtcgtggctgaagatggtcttgccgttgcgatcctggatgcggtcgatcagggtggggcgcaccttcttgccgccgttgaccagcatggcataagcggcggtgaggcgtagcggcgtggtctcgccggcgcccagcgccatggacagctgacggggcaggttgtcatagatgccgaagcgtccggcgtaatcggccaccttgtccatgcccagcgcctgggcgaggcgcacggtcatcaggttgcgcgacttctcgatgccgacgcgcagcgtggtcgggccgagatagtcgtcgtggtagttcttgggacgccacagcggcaggcccggcccctggggcagggcgatgggcgcgtccagcaccagggacgacggggtatagccgctttccagcgccgccagatagatgaagggcttgaaggacgagccggtctggcgcatggcctgggaggcgcggttgaactggctcttgccataggaccagccgcccaccatggccatgacgcggccggtatgggggtcgatggccaccagggcgccctccaccttgggaatctggcgcaaggtgaagaaattggcgggatagggcttgccgtcgtcccccttggccaccggctccaccaggatgacgtcgcccaacgccaccacgtcggcgggcttgcgggggaacggccccgtggccgacctctccagggtggggcgcgcccatttcatctcggcgaagggcacatggccgaccttgccgcccaccaggcccagggtcgcctcgtggtcggtcagcgccagcacgacggcggtctgccacgcctcgtcagcgccgcccgggcgcggcacggcggccagcagcggcccccagccggcggcggcgggaatgcgggtgatgggaccgcgccagccgtggcgccggtcataggcggcaaggccctggcgcagcacccgagagcccaccgcctggagatgggcgtccatggaggcgcgcaccaccagaccgcccttccacagggccgattcgccgtacttggcctgtaattcgcggcgaatgtcctcggcgaagtaatcgccgccctgggtggcctgcatctccttgcgggtgcggacctccagcggcatggcgaccatggcctgatactcggcctgggtgatcttgccgtcctcgaacaggcgcccgatcacccagtcccggcgctccttggcggcctgggggtggcgatggggattgtaattgttgggcgccttgggcagggcggcaagataggcggcctcggccacgttcagctcgtccaggcccttgtcgaaatagttcagcgccgccgccgccacgccataggcgccgctgcccagatagatctcgttgagataaagctcgaggatgtggtccttggagaaggtgcgttcgatgcgcagcgccaggatggcttccttgaccttgcgctcgatggacacctcgttggtcagcaggaaattcttggccacctgctgggtgatggtcgacgcgcccaccggccgccggtcggcgcccttgccccggtttttcaggttgaccacgatggcgcgggcgatacccaccggatcgatgccggcatgggtgtagaagttcttgtcctcggccgagaggaaggcatccttgaccagctggggaatgaccggcagcggcacgaagacccgcttctccaccgcgtattccgccaccaggcggccatcgccgccatagacgcgggtggtgatcggcggctcgtaatgggccagctggtgatagtccggcaggccgcgcccgaaatgccagaagacgaacagcaccccgcccgcccccacgatggccagcaggatcaacaggctgaacagtcccagaaaaaagcggtacatgagggcggtgccttgcggtttgggctggtggtaccgcctcgcggcctccggcgtcaagtgcggggaggatgcagccgttaaaatcggctgtccatccccatttcggcaagagtggcctctcggcctacggcttgcgcgccgccgccttgatgggttcggggcagtcgatgcggctggtgcccaccagcgaggtcttcatgcccttgggcagggtgcgcatgacctcgtccgccgcctgggccagttgcggccgggtgggcggcggtccgtcggtgatcaccagatggttgcccggtcccgagcgcagattgtagtcggtccagcggtagaccatcatccagcaggcgggcacgatccggggacaggtcaggcacggcaccgtgggcttggtctcggcccggacgggaagagcccaggccatcagcgccagcacggcaagggcggtcagccgcatgacttagggccgcttggccttgaggttgggcgggaagaagcgctccaccgccttggcgatggacttagccagacgggcgcggtactgcggctggcgcagcatcttctcctcggattcattggagagatagcccatctccaccaggaccgccggcacgtcgggcgccttcagcacggcaaagccggcgaaacggtgggtattgcccagcaggtccatttcctggcccacctcgtccaccagttcggtggcgaacccggccgagcggttcatggtctcgcgctgggcgaggtcgatgaggatgttggccacgtcggcggattcatgggtcagatcgatgccggcgatgaggtcggccttgttttccttttccgccagcgcctgcgcctcggcgtccgaggcgttgcgcgacaaggtatagacggacaggcccctgatctgcgggctttgcaccgcgtcggcgtgcagcgagatgaacaggtcggcgccctgggcccgggcgatggcgatgcgctcgcgcaggcggatgaacacgtcgcggtcacgggtcagatgcacgcgatagcggccgttgcgctccagcatggccttcagttcgcgggccatggccagggtgatgtgcttttcataggtccccgacacgccggtggcgccggggtcgacgccgccgtgaccggggtcgatgacgatcaccggcacgccgtccttggccttggcgacgctctccatggagggggtcggcaccggcgcggcctgctgctgcacgggggcgggcggctggggcaccggaggctggggcgcggcgacgggctggggggccgcgacgggctggggccgttcgggcggcggcggcatgggcgccgacagcatgggcgttgccgcctgtgcccgggctcccttctccaccgccggcttctcggccagttgcggccgctccaccggaaccggaacctgactcggcggcggcggaaccagggtgacgggctcggtcggcggcacgatggactcggccggagcattggggctgttgacgacgatgcggctggcggagggcgcggtggcgggacgcgccgcctcggcgggcgcagcctcgggcagatggaattcctcggccggcttgggggggaccaggacgggagccggggaaggcttggcggcggcgggcaccggagcgacggccttggccgccgccgggggcttgagcaccggcgccctggcgctggccgggccggacccggccgccgccaggaatgcctcgcgcgtggtctcggccagatccaccaccaggcggtgccccatgccgtcgcgcggcgcgatgatgaaggcgctcttgaccaaagcgggcttgcgcaggtccagaacgatccggccgccgtcaagatgcatggaattgaccgatccccaaggcttggagatgccccccggcccgctgtaatccgcgccggacaggtcgatggcgatgcgatagggctcggccaggggcgtgatcttgaaggccacctgatcggacaggtccaggacgaaccgggtgaccccttcgccgtggatgcccaacctggcccccgacgcggtcgccgcctcggacgcggtcaccccgcccagcccgaacgaggtcagggtcagaaccagggccgccagcacgggccacaaacgcgctcttgtcctcatctgcctcacggtcacgggtcgccaagggaacatcagtgacagctataccgcagacgctgactcaagctcaacccaaaacgcattgattcagcagactcttcgcctgatttcgtccactggtcggaccgggtgcaacaagatcgttgtcgaatggtcccggcaaggctattttgactgcccatgagctcgcacgatccgatagtcctcgatgggacggtggcgtcacggtggttcgcaatgactgcgaacccggggatgcgccatgggtcggaccgcgacgccagactagaattcgaagccgggcggattcgcccgcgatcaggttcccgccgaatgaggcccgcatccgtcaccggacgcgcggtcgttttccgaggcgccgctggttccagcggcaagctgattgatcgcccgtgcctgcgcgccggcttcgctggatcagacacctgctcgcatgcgctcagcgcgtcgcgggcggcgccacggagagatcgccttaatggtcaagcgtatgttgatcgacgccacccacccggaagagacccgggtcgtggtcgtcaatggaacccgcctggaagaactggatgttgagacatccaccaagcggcagctgaagggtaacatttatctggccaaggtggtgagggtcgaaccctcgcttcaggctgctttcgtcgagtacgggggcaaccgccacggcttcctcgccttcagcgaaatccaccccgattacttccagattccggtggccgaccgccaggccctgctggccgcccagcgggccgaggtgatgcgcgaagccaccaacgaccgcgacgaggccgaggccatcggcgaaggccatctggccgccgaggcggtggccgagcagaccgatggctccaccgtcgaggacgcccccgccgaggccggcgagaatggcgaggcggccgaacaggcgccgcgcaagcgccaggtggagaccgtgggcggcgacgacgatgccgagaacgagcgccgccgcgcccggctgctgcgcaactacaagatccaggaagtggtcaagcgccgccagatcatgctggtccaggtggtcaaggaagagcgcggcaacaagggcgccgctctcaccacctatctgtcgctggccggccgctattgcgtgctgatgcccaacaccgcccggggcggcggggtgtcgcgcaagatcgtcagcgccaccgaccgccgccgcctgaagtccatcgccaacgagatggacattcccgacggcatggcggtgatcatccgcacggcgggctcggagcgctccaagaccgagatcaagcgcgactacgaatacctgctgcgcatgtgggacagcgtgcgcgaactgacgctcaagtccagcgctccggccctggtctatgaagaggccagcctgatcaagcgctcgatccgcgacctgtattcccgcgacatcgacgaagtgctggtggacggcgacgagggctatcgcctggccaaggactacatgcgcatgctgacgccgtcgcatgccaagaaggtccagccctacaaggacccggtgatgcccatgttccaccgctatcaggtggaagcccagctggacgccatgcattcgccggtggtccagttgaagtcgggcggctacatcgtcatcagccagaccgaggcgctggtcgccatcgacgtcaattcgggccgcgccaccaaggagcgccacatcgaggagacggcgctgaagaccaacatggaggccgccgacgaggtggcccgccaactgcgcctgcgcgatctggccggtctgattgtcatcgacttcatcgacatggaagagaaccgcaacaaccatgcggtcgaacgccggatgaaggaagcgctgaagaacgaccgcgcccgcatccaggtgggcaagatcagcgccttcggcctgctggaactgtcgcgccagcgcctgcgcccctcgctccaggaaaccaccttcagcccctgcccccattgtggcggtaccggcctggtgcgttcggtggaatccgcggccgtgcacatcctgcgcgccatcgaggaagagggcatccgtcgccgctcgtccgagatcaccgtctatgtccccaccgccatcgcactgtacatcctgaaccagaagcgctcggccctggccgccatcgaggagcgctacgagttcgacgtgctgctgtcgggcgatgacaccctgatcccgccagccttccgcatggacaaggtcaaggcggagttccgccccgacgagccgccgcgcgccgccatctccatggacgacgccgcccaccgcccgcccgccgagcccgagccggaagaggccgaggaggaggacgacgaggacgaggaagaggcccagcccgaacgctcgtcccgtgccagggaagagcgcggcgaggaggacccggacagcgaggccggacgcaagcgccgccgccgccgccgccgtcggcgcaagcccggcgatgaccgccccgagcaggacggcgaggccgtggccggtgacgaacagccgcgagccgaaggcgagtcgtcggccgagggcgaggctgaatccgaggacgatgaaggcgatgccgagggcgagggtgaaggcacccggaccgaggggggcgacgacgatcagccgcgcaagcgccgtcgtggccgccgtggcggccgccgtcggcgtcgccgtgatggcgagggcgagggtgaaggtgccgaagccggtgaaggtggcgagaccgctggagccgatggagccgaaggcgaaggcgtcgagggcgtgaccgcccccgaggccgagaccgtcgcggccgcgccgcaggacgccgctgccgaggaagccgccgccgtcgtggaagaggcagcccccgccgccgaggaaaagcccaagcgcaagcgcgctccggccaagaagaaggccgaggccaagcccgaaggcgccgccccggaggaggcccccgccaccgccgaggagaagcccaagcgcaagcgtgccccggccaagaagaaggtcgacgccaaggctgaagcggcgcccgccgagatcgccgtgatcgaggccccggtggctgagagtgtcgtcgccgagcccgaggttgtcgccgccgagccggtggctgccgcccccgagcctgtcgtcgtggccgaggagccggtgattgccgtctccgcccctgcgcctcagaccgaggccgagccgccggcgccggccaagccgccgcgcaagggctggtggaaccgcctgatgtcctgattcgacatgtgcggcccccggttcgccgggggccgcctgtcgcagcagagggacccgccgcgcatgaggagtgttcgttcgctcatcgcagcctttgccctgctggttgccgccaaggcggcggtggccatgccccatttcctggccaagcagaccgaccagagcctctcgttcaccgtgacgcgcaacggcggcgccatcggctaccacaatttcgtcttccggccacgcaagggcggagtcgaggttcgggtggaagcggatatccgggtgagcttcctgctcatcccgttcttcgtcttcgagcagcagggcgtcgagatctgggaaagtggccgcctcgtctccatggactacgtcaccaatgacgacggcgcccgccactcggtcaaggccgagagggccgggagccgcctgcgggtttcggtggacggcaagccccccaccacccatcccgagatgcttcccggttccctgtggtatccgccaagccccgacaccaccatgatgctcgatcccggtgatggcagcccgacgccgctgaaggttcaggcgctgggcgaggacaccatctcggtgcggggcaagccgacccgggccacccgctggctgtgggatgacggcctgcgccgggaattgtggtacgatgccgatcagaccctggtccaggtatggatccggggcgatgacggctcggacatctattacgtcctcagataggcttggcccatgcgcattctgctggtggaggataacgaccgcctggccgagttcatctcggcggggctgaaaagcgccggcttcgtgcccgacgtgttcggcaccgtggccgacgccaccgccgccttcgaatccgccgcctatcaggcggccatcctggacctcgggctgcccgacggtgacggcctggacatcgtccgcgcccagcgggccaaggcggcgccttgccccatcatggtgctgaccgcccgcgaccgcgtcagcgaccgggtctcggggctcaatgccggagccgacgactacctgctgaagcccttcgccatggaagagctgatcgcccgcctgcgcgccatcctgcggcggccgggggcggcgctgtcggtggagctgtcgctgggcaacctgaccttcgacaccgccgggcgcgaggtgcgggtggacggccagttggtggccatgccgcggcgcgagatggagatgctcgaacatctgctgcgccgctcgggcaaggtggtgtccaagcgctcgctggaagaggggctgtacggcttcgacgacgacgtcacccccaattcggtggaagtgctggtctcgcgcctgcgcaagcggctgcagcagacgggggcgggggtcaccgtccacaccctgcgcggcatcggttacatgctggcggacggcgcttcttgatccgccaaccgccggccatcctgtggcgcatcgtcgtccgcctgtcactgaccaccctcgtcgccatcgtgatggcctattcctggctgtggtggaagtaccactcggtcaccgaggtcatgcgcgacacctatctgatcgagcaggccatcgccatccgcaatcaggtgaccgtccggcccgacggccggatcaccgtggatctgcctcccattcagacggcttcctatgccgagtcggagggctcgctgcgcttcgccgtccgcctgcgatccagcggcgccatcctggcccaggccggcgagccggtggggccagcccccgagatgggcgacggcccccgcctctatcgcagcaatcccgacgggcctggtccggtgctgatgttcggcgccgccgtgctgctcacctccccggcgggcgaattggtcatccaggtggaggaaagcggcagcgatttcgacgccatgacccgctcgctggtggagcgcttcgccaaggagggcggctggttgggcgccccgttcctgttggccatgctgctggtcagcctggtaaccatccgcaattccctgctgccgctgaagcgcctgtccgagcaggccgccgccatcggaccggccagcaccgacatccgcctgcccgaagcccaggtcccgcgtgagatcctgccgctggttcacgccgtcaacagtgctctcgaccgcatcgaggccgggttccgcatccagcgggatttcaccgccgatgccgcccacgagctgcgcacccccctggccgtgctgcgcgcccacgtggaaaccttgcccgaccccgccatccgcgaggccctggtccgcgacgtggattccatgacccgtctgatcgcccagttgctggcggtggcccgtgccgaggccctgaccatcgccatggacgaacaggccgatctcaacgccatcgccgtggacgtgggcacctttctggcccccatggccctcaggcagcggcgcatgatcgaggtcatcgaagcgccgcgcccctgcctcgtcaccgccaacgccgaggcggtgttcaacgccgtccgcaatctggtggaaaacgccctcactcacgcgcccagcgacaccacggtcaccgtccgggtggaagcccccgccagtctgctggtcgaggattgcggccccggcgtccccgccgaactgcgcgaacgcatcttccagcgcttctggcgggcggaacggcgcaagagcggctcgggtctgggactggccatcgtgcgcgagatcatgcttgcccatggcggccgggtcgaggtgggcgaccgccccggtggcggcgcggtgttttccctgcactttcccgatcagggtgcccagcggcgataggccaacgcgcccaggatgcaggcgactccgcccagggccacggtgggctgggggccgatccgctcggacagcaagcccgccaaaagcgatcccgacggcgtcgccaccatgaaggtcatggagtaaagcgccatggtccgcgcccggaaggcatcgggcaccagcatctgcaccagaatctgcgacgcggtgttgtgggccaccagcgccatgcccgccagggccagcagccccatggacagcatgccccagcgcgacagggcgaaggccaccagggcgacaccgaaggcgcacaggccccaggccacccgcccccgcgacgctccctgcatcggcccggccaccgccagggaggcggccagggcgcccgcccccgccgcgctcatgagcagacccagcatttccggcccccccgccagcacccggtcggcgaacaccggcatcagcacggaaaacgacatgcccatcaggcccgacagccccagcatggccatcagcgccaggatggggccatgcccggccacgaaggcaattccctcccggacccgtgccagcatgctttcgcccgccggcccacccgtggctgacgccggttcggccatcacggccagggcgatgatcacgcccaggaagctcaccgcattgagcgcgaagcaccagccctcgcccagggccgccaccagggcgccggccagggccggggccaccagccgggccgcgttgaagatggaggcgtccagcgccacggcgctccccagatcctccttgcccaccagatccacggtaaaggcctggcgagccggaatatccacggcgttgatgatgccgaacagcacggccagggccaacacgtgccagatctgcacccatccggccagggtcagggccgccagccccgccgcctgcagcagaaaagccccctgggtcatcaggatcagccggcgacgcggcacgcggtcggccaccgcgcctcccagcaatccgaagatgaagaccggaatctgcccgacgaacgccaccagacccagcatctcggccgagccggtcaggcgatagaccagccagctttgcgccaccatctgcatccacgaccccatcagcgaaacggcctggccacaaaagaacaggcggtagccgggatggcggagcgcatgcccccaggggcgccgcttagggctgggatgagtgtcggtcatgacggtcatcatggcatcccccggcgtttggagctatcctgaggggagatcgagggaggctgtggtggcacgaatcgtggtcctgggcagtgtggcccgcgacgaggtcatccgactggatcatcgcctgcgggaaggcgcccatctgcagggcgccccgccccttgcccggctgggcggcggcggcgccaataccgccatcgcgctgactcacgccggccacgaggtctccctggtggcggcggtaggcaccgaccccctggccgacgagttgctggccgagctggcgcgccatggcgtcgatatcggcccggtgacccgcatttccggccccagcacccattccctggtcctgctggaccccgagggcgaacgcaccatcgtcaatctgacccgggcgcgggaaagccggccgccccggcgcctgctggatctggcggccgattgcgtctatgtgcgctccaacggtcaggtcctggaggatctgctgcgggaaaaggcggcgctgtgccccatcatcgcccagatccggccgctggaagacggtctgcttcccgcccaggttctggtcggctcccacggtgacctcgatgccgacctgctgtccaatcccctggaagcggggcgccaactggccggcgacatcctgcgttgggtggtgatcacccacggcgaggaaggagccgaagccttcggcgtcgatggccggcgcctgcgggccaccgccccggacgtggaggtggtcgacaccaccggagccggcgacgcctttgccgccgggctggcccacgccctggccctggggctggacatggagcgggccctgcccctggcggtgggctggggcgccgccaaggtgacccgaccgggatcgttcctcgaccgcgagaccgtgcgcgagattctcaaatcggccccggggccgcgcctttaacaggctgccggagactccgcttcgggggctttcgcccccgagcccccaaccgggaagcacagcttcccgaacccttcagttttcaaaaactcgaggctcggaggctgtgcctccgaacgggtcagggcgggtgccctgccgcgcaaacgggacttttccacacccaactaaagaatcgactgcccggtcttggcccaatcggccatgaaggcggccaggcccttgtcggtcaggggatgctgatacatctgccgcagcaccgccgccggcatggtgaccacgtgggcgcccaggcgggccgcctcggtcacatgcatggggtggcggatggaggcggccagcacctcggtgcggaaggccgggtattcccggtagatggaaacgatgtcagcgatcagttccatgccgtcctggccgatgtcgtccagacgtccgacgaaaggcgagataaaggcggcgccggccttggcagccagaatggcctggttggccgagaagcacagggtgacgttgacccggacgccgtcgtcggacagcaccttgcaggtcttgagcccggccggggtcagcggcaccttgaccgccacgttgggacgaagggcggccagcttgcggccttcggccagcatggtgtcgaaatcggtggcggccacctcggccgagatggggccgggcacgatgtcgcagatctcggcgatgacgtcgagaatcttgcgccccgacttggcgatcagcgacgggttagtggtcacgccgtccaccagtccggtggcggccagctcgcggatttcggcgacttcggcggtatcgatgaagaacttcatatgcggcccccaggcgttcgtgtgcgggccacagactaccagggaggcggcaggcgtcaatcgccggggaaggtcaatcggcggcgcgcttcagcacctcggtgatggtcaccgccagatgatcctcgaccaccaccacttcggcgcggcagaccttcttgcggttgacgtagagatcgacgggatcattgaccttgcgatccagctccaccacggcaccgcggcccagcttgaggagctgggcgatgggcaggttggcggttcccagcaccgccgagagctccaccgagacgtcatagaccgcctcgcggttgtctcccagacccagggctgcgttgatcgcgtcgtcgctgttggccatctcgcctcatccttttggcccagaatacgcgggcctttacaatatagagcatatccggcatttccgaacatccggttaaccggacgttcggatagagttgcatattggagacggttgcgatcgggtgatcagccccgctatgatccgccccgggcagaggaagggcgcatgagcactgaaatctactcctgccgcgacggccaggacctcaagcagggcaagctcgactattccgacatcgatgatcgcgaaaccgccgagatcgatgccaagcgacgctgcaagcttgatcccaccatcaagagggttgcctattacaaggttgccgctgatggcgacttccgcatgttcttctcctacaccaatccccattgcaagccggcccccaaggcgaagccggtcagcctggcgaccgccgcccgcaaggcggcacccaagaagaagcctgaacccaagccgggtctgctcgcgcggctgaagaaatcgatcggcctcacgtgaaactggaactgctgcactgccatccccctgaaggcccggccacccagcgcccggccctgctgttcgtccacggctcctattgcggcgcctgggtgtgggccgagcatttcatgccctatttcgcccggcggggctggtcgacccatgcagtgtcgctgcgcggccatggcgagagcgaaggtggcttcaattacgcctcggtggccgactacgtcgccgacatccactccgccatggaccatatgggcggcgaggtgatcctggtcggccattccatgggcggcctgctggtccagcactgcctggccggcgaccaacgggtgcgcggcgccgtgctgatggccagcgtgccgccctcgggcctgatgtcctcggcgctgcacctgtccatgttctcgcccgacgtctgcctgcaattcggcgtgctgcaggccctgggcccgtcggcggtgaagggcgacgtcatccgccgtgccttcttctccgacgccacgccagacgacgtcctggcccatctgctgccccggctgcaaaaggaatcgcaccgcatctgcgtcgaactgctcaatcccagccggccacgcctgccgctgggccaggatcggccggagattctggtgatgggcggcgatcgtgacgtgctggttccagcctcggccctgagggagaccgccacctatttcgatgccgagctttccttgctgtccggtgccccccatggactgatgcttgatgattgctggtggcagcccacggcggaacgcacattgtcctggctggaatcccgcttctgaaagcgtggatcgcgccaaggtgcccgcaacccgaacacactaaccggcaaaagccactgaaatagaaagagggtaatgcccccttttttatcagatgctgcttttgccgtgtgcatgcactccccccctgcccggcatatttctttcatcggagattcgcccaatgggcggtcgcgacacaatgtcgcgctgtgataacgcttcccttcgggacggggtaaggctatgattaacgtcggattaatctaggttctgtgtatctaggctccatcatggcattgagcaccaagcaggtcggatcggcggcggcggcgtcaagtgtggcggcggcgacggctcgtgtcggcacgggtgggcgcaatgtggcctcctcgacccgccccgatgtggagcggctggattacgcccagcacatggggctcaacgaggaatccatcctccggttccagcaggaaaatgggatcaatcccgatggcggccgccgccagcgtgagggcaagggcggattcgccccacagacgtcgctccgaatcttcgagtacggcaccgacaattccgaagacggcagcgaccccacctcgtcgaaaattttcctcaacgacgtcctgcgcggcgtcggcacctatgagcagaacatccgcatcacctcccccggctcggtgaagccgggcagcgtgatgaactacctgttctgacccgcctcacaatccgatccggacgcccgctcccgggcgggcacctgccggcgtcccagcgccaatggtagtcgaatcgtcgcaagcggacacaatggctggttccgcgagttcttcatgccgccaaaaccattgcgcgaccaagaggactcatcgggagttgtcataaggtattcactgtatctagactcttgcccgccgaataccaacattcccattctgtgcatgactgtacatggattcccccctcagagacttcagacctagccgaacgaaacaaactggattattgtgagcttacgccagcacgcgagtttggggggggatggtatgttacggctggcgctagcgcgtaaaagtcatcgcggtaaacctctcttttcccggctgtttccgccttgcgggtctgtgacctcgcaccaaggcggaagacggccagcgtcattctctagatgaggaatgaaaaatgaagagcatcacacggtgggtcggcctaagtgccgtcgcagccctggctgcttgcgccatgcctgcggacgtgtcggacgtgcagacgatcctcggatccaaggcaacgacggggacacctttcacgcaggctttgttccaggaataccaggcctataccaagcagcaggtccagaccgaagtggaatgggtcgacgcctcggaaaccgcccgcaagggcctgaaggccggcgccggcgaagccgtgcttcccgacgagttgggcacgcgcgttcttcccgccgcgacggtcccggaactgactgcagcgcgggcgcgcctgatgggctatttccaaggcggcgccacccagcgggttcccgcagccgccgccaaggcgcaggttgctttcgattgctggcttgagcaggcggccgaaggctatgccgccagcccctgcaaggccaccttcctggcccatgagccgatcctgaagaaggccgtcggcgtcaccgaagttgccgccgatgtgcgccgcagcttcatggtcaatttcgacctcggctcggccaagctttcgcctcaggctctccagaccctgaaggaagccgccgccgcccaggcgcagatgtacgccccgctggtctccgtggcgggctatactgataccctcggttccgccgatgccaatctgcgcctgtcgcgtcagcgcgccgacgcggtgaccgccgaactgaccaagctgggcgtcaatcccgccatcatcgcggaaaacgccctgggcgagtccagccttgccgtcgccaccggcgacaacaaggccgaggccaagaaccgtcgggtggaaatcaccctggcgggtccgacctggtcgcacggccgctacggcggctatgcctatggcgatcgcggccatggctggggtggtggctattacggccacaacggcttcgccgtgttcttcctgcccggttccagccggctgggaaccgccgatatcgagcggctgaagatggttgtcgccgcccagaagaacatgaagcccaagaccgtcaccgtcgtcggcttcaccgaccagaccggctcggccgcgaccaatgcccgcctgtcgcgcgaacgcgcccaggcggtggccgccgagatcgccaagctgggtggcagcaccacctcggtcgaggcgcgtcccggcgagacctggggctcgtcctatgacgggcaggcccgccgcgtcgagatcctgttcggctattgatgaacccggaggcggcgcccgggaccagtccccggcgccgcgccatccgaatatgagatgtgggagcaaacacaatgaacaagtcccgtatcaccgcgttgatcgcctgcgtactacccgccctgggtggctgctcgggcatctattacgctagtgaggcgaagccgaccaacctggtgccgccggccgagatgcgctatgtggtgcctgccgggtcgtatcagaacgacctgaccgccctggtcggcaccttcgccgtctacaacaaggcggaccagaccctgcaggtgctggagccggtggccaatccctatgacccccgcacccgccctgtggtggaaaccgtcaagcagaccctgtacaagtccgtggtcaatccctccatccagaccgacattccgctgatcaacgcggctttgaaggatgcggcgggccaggaccttgaagtcaccatcactgacgaagcccacgcgatggtgccgaattattcggtcgacatcctgagctatatcggcagccgctatcgtccgaccaaccagaacgaggaaatcgtctatgtggccgaggcctggcagcgccgcttcaatgcggccctgctgaccgcgaccgaacatagcgcctggacggccaataccggcgtggtggtctacaacaccaagacctacacccggaccgaagcctttaaggacggcagcttcctgacggtctcggtggttccctacgccaagatccagggcgccaagcccggcacggccctcgaagccctgccggtctcggcgatcacctccatcaagccgcagatcggcaatccctatgcctacacctggcatcgggaaggctggggcggctatggctacggctatggctatggctacggccaccacggctacggccctgccaaggcgaagcccaaggccaactaggctggggctttgctgtgcgatcggggcgggtagtcactacccgcccctttcttttgccgagaaacaaattgccacggagggcgcgtgatgatctgtaaagtctgcggggccgcgacaaccaccgccgaggtttgcagcgaaccgtgccgcctcaagctgcaatgcagacgcatcgcctgggaccgcgccgcagccatggtcggggtcaacggctattacgaccgccgctaccgcgaacacctgcgcagccacaacacgcgcggcgccaaaactatgctgagggaatggaaagccgcccacgccaagctcggcgagcggccctagccgcccggcccagcaatcgaaaatgtgccctaggcggcactcttgagcagcaatgttccctgacccgccggcgcatcggccctggttactgcgaccgcgcccgcatccacatccatccaggcatcgcaactggacagcgcgatccagcgggcttcgtccgcattatccgcagtcacttcaaggacctcgggcttggccacatcccgggcaatggacacaagaaatttcggcattgccgatctccttcgcaacagcaacatcccgtgctccgtcctttgtgcccgtttttttggcgtaggtggttcccgaagttcacacgcccaccatgcgaaaatgctgctatgcacaaaagttatgactcggaacatttccgggtgactgccggcccgagggcgccaaactttgcacttctccggaaatgggatttcaaattatcctagttccgcagtgtccagagcccctcctcatgggggatagcctgtcgacgcgaggggaaatatcgggagaattcgcatgaaactgaacgcattgggagtgattgccgcagccactcttgccgttctgacctccacctctgcctttgccgccgatctttgcccggtgggcaagtcggtcaaggtgaactggaagggggattggtacccggccaaggtgaccaaggccgaaccggcgcgctgctttatcgcctatgacggctatggccgcgaggacgatgagtgggtcggacccgaccgcctgcccatcaaggtgagctggaagggcgagtggtatcccgccaaggtgatccaggtccagggcgacaaatacaagattcactatgacggctacgccagctccgacgacgaagtggtcgacgtcagccgaattcaggtccgctaggacccggccgggggctctccgacgggtcctggccttccggagagcccccggccggaagcctttcggccgcatgcccgtgactttgcaatggaggttgccttggttccgatcagaaacatcctggcgtcggctctatgcctaaccgccctcgcaacaccggcctttgcccaatcgggcggctccggctcggcgggggatgccccttcgttgtgcaagcccgacacccgagtcgaaatcctgtccgagggcgcctggtatcctggggtggttctcgatgccctgcgtgatgggcgttgcttcgtccactacgatggctacggcgccgatgacgatgaagccgtggcacccaagctgatccggtcggcccgctgatccggcaggcctctgacgcggcccgaactcgaagagcggtgcggcgcgtggcatggccgccgcacccgtcgtcaggcgacgatcaatcccaggatgcaaagcccggtcaccccggcgaacacccagacattggctgccccaaagctgatctggcgcccccgcagacgcccgacccccatgatcgccccaaccaaggcagcccaagccagcgccggaaaggcgacaaagaccacgagcagcaaactgtcccaggcgtccatgcgcccctcccccgcaattgtcacaacaatacgtggctgacggcacggctccaagggccatatgacggtcagcccctcggagcggacggagcccggtcgatgaccggcctgacccggaaggccgtcagaattatcaccaggaacggcagcaggatgatcaaggggacaccgaccgcaaagagaatggccagatccaggccgatgatctccagcagatcggacagatgccgcatgcgaaacagcgcgaccacggtgaaagccaggaccgctattaccgacaaggcggcgctgccgttgacgataccgcgctccagcctggagggggtgaggttgggcgagaagtcgaagaacaggaactgataaccccagcgtttgatcgccctgccgataatgcccggagccaggaagcaccaggccagccacagggcgacggtaatgccacaggcaacctcccagccgcgcagcccgagccaagtggcgatcgccggcaaaaggaacaggggcgccagccagcagagcttgtgggtctgcgaacggaagacgaaacggatacgggtacccagttggggcaaataggagctctcaaccaggcccgccgcctcggcttcggccaaaatagcggcttcggcctcggcctccgcttcggccttagcccgggcaacagcccgccccctcgacgccaggtccatcgccgcccgattcagggtggcgacttcgccggcgacctcctcgggcgtggccgtccggacatccgtcaccgtcgcggaaaaaaccaatgtctggccggccagtggatggttgccgtccagcccgacgttccggtcaccgacggcggtcacgcggtattgcagggtgacgccgttaacatcccgctccagcacgtcgccgaccttgggaggcgcctcgaggcggtccagcgataccgtcatggtcagcgcggtgtcaaagggtccgaacccgtcctcgggcgccaatgtcacttgaacgctgtcgccggcgcccaggccatcgagagccgcctccagcttgggaaagagcccgccatggcctccgtgcagataacttaggggctcggccccggggtcgacgacgtcgccgtccggggtggcaaccctcaagcgtaaggtgacggcggtgttggcttcgatcttcatggtgcgccccggatgagacccctgctgtgaaatgcaggattatcgacctgccacaatcggccgcgatgggcaagccgtggatggcccgccggccaaatccgccctattatcgcccccgccacaggagggggaaggctcggcgctatggacgatacggtggaaattcggctgggaccgcttgctgctgtcaggtgggtggggtgggcattcctgttctccaccgtgggcctgggattcatgtcggccgatctggccatgccggaagatgtgcccatcggcctgggcctcggctgggtcctgctggcctgcggcggcctcttcgcggccctggccgtccgcacctattgctggattcgggcgcataaggtgattctgaccctgacctccgacggcatccggggacggcccacccaggacgtgctggtcccctggaaccgtgtcatctccgtgcggcgcgatacacggcgaccatccaccttcgccctcgccacccagagcttctggctgagctacatcgtttcgaccaacgacccattccgctacgacgtctacaacgtcacgctggacggagatctgaccaaaaagggcgtgcagggcgagcacgcgcttggcctaggctttgacatcattcccgccctcatgtcgttctccagcgctcgggtggcgcacgcattctcgcgctggctcccggctgagcgctgtatcgatttcgagaaccgggccgacccgctcaccccccaggagttcagggatcggctgatggagaccggtacggccttggccctgaggctggacagcccggtcacgcctctgtcgtccgcaattgtcgctgaaacgacagcttcggacatcgtggctgacgggcaacaaccagccagcggcaacgacaccgcgacaccgtcgcagagcgaagacgacacgtccaccgccgatccgggttccgacgatgggggcacggatgacgggggcagcgatgagtcaagctccgacgactaatcagaggggactcccgagaccggaaatgggggcgcacgtgactgtaatcgtccttccaagcggcccgcgcagggaagtaatcgaaacaatgtctcgttgacgccagcgtccggtaccgcagcgagtcaggccgggggtctcaggtccctcgccaaggaggcgagacatggcgttggcgatgagaatcgtttccgctaaggttgggggcgtggtccgcttctgtcggatcggcattgttccggggagagaccaagaccatggcaaacgaggctagtctcgataatctgcgagccatctatgagcgggtccgagcggaaaccccatctctcaactccgaaagtagcgacttcgccgcggcaagcctcacttacgcccggctgaagcaatataacggcatcgcggcggccatcaatcgttgcgtcggcgatgccgtcgtaccctgcatgccaccccacctgcagatcaacaatcacaacaagtgcaacctgcgctgcgttcagtgcatgtattttggcgaagataatgcgggaccaaatcacgacaaggacattcttcggtcacgacccaacatggacacggtcgaagccctctgccgcgaaggcttcccttatgccaacaacagttcgctatccggcatcggcgaagggctgctccatcacagcgccgagcttattgcccagctagccggcgaatacggcgtgcggatgatgctgaacaccaacggccaggttctcatgtcgagacggattcggcacctgttcggcattggcagcctgatgttttccattgatggcggcctcccccacaccttcgaatcgctgagacttggggcgaaatacgctaccgtgatcagaaacatgcgtacactgtcgcgggcgaacgaacttttgccgcgcccattgcgcatgcatacccgcatttccttcaccacctgtgtcagcaacatgatcgagctgccgttgatggtggaacttgccgcggcagtcggcattcgcgaattggcggtttcatcctttaccttgtacgatcgcgggccttttgcccttgagatgatcgcgccgcatcaggagcggttcgaacggctttacgccatcgccgaagaaaaggccaaaaccctgggcgtcagcctcttccgaacggtgtcccccgtctatacgcccccctattacgacccggatcagcccggcgggcggctcatggttgactatgcggatccgttcgacgagtcgcgcctggttccattgacggaattggttccgaccgacagcgtcgaagacgatgcccgcgagattgccgcagatgccctggaggccggcatcatccgcaagttgacccaggccacgccccagcaaaccgaagcagcggcagaggccgtggaggccctggccgccggtatccgagatttcatgaactccacccccggcatcgccaatctgggagaggccgtcaccaagcgcaagatccgtgagccgggatcctggcgcccgatttgcggctatctgttcagctctctctacctgtccggaaacggcatcgcccaaccatgttgcaacgacaagatggattggttggccgattaccgcaaaacccctatcaaggaagtcttctccggccaaccctaccgggagatgctggcgaggttccacagcgacagcccgcctcaagcctgcaaggactgtcacttccgaggctatgtcccagaggagagtctggtgctgtgatgatcaggccgggctcacgggttggacacggccattaccgcctgaggcaattccgatagaccaacccaccggtcagccagatccgtgacgtcgggcggtgggaccgccccgtcggccaacaggccgatgacgggaattttgtaccggcgcgccatgtccagcgcggctccggcccaagtccgcccccgagacgaggtcgagtagaccgagggcaggaaaatcaagacatgagacggcgaaacctgcgtctccagtatctcacacaccagcgccgcaccttccggcgagctgagtttgatgcaggggtcgtaccatgggttgccgaaatttcgccaacccaagccaaatgcctgatccagacaatgggttatctgatcgatgtccgcacgccgatgccaatcgtgagtaatgaagatatcgatcatgtccccctccatcacctcgagagaccgagcatcccgaggacgttgcgccccggcgtggggcgcgtctgctcacatgccgatatcggcgcaggtcactgggtagaagctactgctgcacggcgtccttggaccagtagacgatctttagcgacttcaaagcacggtccatcccatcatcataaggaagggcgagaatgtcccccgccgcggacggaacgatcaggtggttatcgaaaatcttggatcttccaaccgcctcagccttgtcgggcagggcaatccgtccgggattgcccgccatgatttcctcgtcgacaatccactggcggtaaagagtgtgaccacctcccgagagagcatcatgcatattggcgagcacctctccgcctatgggaatgtttgcagcctgcagacccttgaccagcctgacgaagcgctcggcacgcacccccttgtccacatacggattgatgctgtaccataagtgatcagggacaccaaaatagtatttcttatatatagcctctttatcgccataaaatccaatcccatgcccttccggattcaaccagtacacactactctgaagcagtagacacatatttatattatttactagcgggaacaccgatctattatctttaaaaaactcaatcgtgtcgtcaatatccttctccgtttctcccggagttccgatgacgatattgatgttcggcgtaattccggccttgacgcaatcctcgtgatttttgatgagcgtctcgatcgtatagcccttcctctgaagcctgatggtattttcagtgaaggcatccgcaccaaaattgaggccgacaacgcccgcagccttcatgagggacagaaattcgacgtcgtatttcttgttgacgcgaatttgccccgaaaacacgagcctcagaccgcgccgcacgatttcctcacaaatttggcgcaggacttccggttccccgccaaaatcgctgtcactggcggaaaacgacgggttccggccggtcgccatgattctttcaagctcgtccacataaagcgagggactgcgcgagcggaacgaaaagcgttcggcgcagaatgtgcagcgtgaccagacacaccccctggtcaggggcacggcggttccttgatagccggtggatgaacgatagacggcgttgatatcgtcgaagaaatcgagtgcgatacccccgagcgcatccagattatggggcttggggcctgggatgaaccggcggccgggatcatcgaatttggagataactcccggcagattggccgggcgctcgccgcgcgccaattgttccaccaagggcccgaccaccatgtctgcctcgccgatcaccatgtagtcgtattcgggaaatgctccccggccgaacgtttcgctgacgcagctgtgccctccgaccaggatcatggtctccggcatttcccgcttcacacggcgagctaattcccgtgaaatccattcgttgcgctgatgaacagacatcccaaggaccttggggcgagcggctttcaactctcggaagatctcgtcgatatcgggggcaaaataatcgagcaacaacggccactgccggggatcgatccacaacctctcgttatagccccagggatcgtcagcaaaccgaatcccgttacgcagcaagggctgctcgccaaggtcaaacaggcggcgaacatgaaagcgatgatacatgatgatgtcggcatccagcgtctggaaccgcacagacgagcgcttgagcgccgagtggacgtaggacagaccgaccgatatttgcaatccggccttggacggcaggtccagcaaaacaagatcgaggccgggagttaacttgaggccggggatgtcgaatgggtagatgccggaatcctggggaatccagcaatgaggcggaacaagctcgatgaattgcttaacggaatccgggctgaacacattgattccggcagggacgcgccgctccagccgccagcgcggctccgtcttcgtctcacatatgaagatcgcggtaatgtccgggggaaggtcgtcgatgctgcgaacaagcggccgccccttgtaatcttcagcctcgcccagctcgtcgatcaccaccgcaatgcagtccagaacctgcggcaccgtctgcgtaaagaagtctagaaacgggcccgatttccagaacgcaatctttccccccatgctccccagactggcggacacgcgggcgagaatatccacctcatgcggctcgcctgtcatcgggaaacatcgataggcgctaaaacggacgttctcgccaacggcctcaaccatttgctgggtctgaggatcaaccaatgatacctttacgagctggttcatagcgcctcacctttgcccctgcaacttcaagaatcggcgttccgcgatagagctgtccgtcgacttccgacccaaggcacgtatatgggccgatgccggcccaatcggtaggtggacagacaaacttgcccggaggtgtccgaagccgcggccatgatcccattaaagagtgaacggcaagttacgcggcggtgaagattgacgaggccgctgcgccggggtaggcaggtgatgtcgacggcggcggctctccgtcagcgggcacggcgaagaactcttcgatgcgggaatccgactgccgccgccagccgggccagaacggccacgctcagcccctcaatgtgcatatgacttttggtgtggcctcgggtatgctgccatttagcgcagagttgttgaggcatcgacccgcatgggcattctggatcagaacatcgactatgaccggcccgtgaaattggccgacggcgttttctgggtggggttcgccgacctggaaggccgccttcagtgcaacccctacctgatcgtcgatggggacgaggccatcctaatcgacggtggctcgcgcccggatttcagtaccgtgatgcgtaaggtcctccagaccggcgtgtcgccccggcagatcagccacctgatctaccagcattatgatccggacctgtgcggctcgattcccaatctggaaagcctgatcgactcggccgagctgaagatcatctcccatgccgataacaacccgttcatccggcactattccgtcaactcgcctctgttgtgcatcgaccgcctggagcggaaattgaccatgcgctcggggagaaccttgcgtttcttccgcacgccctacgcccattcggcgggaagcttcatcacctatgacgagaccagcggtatcttgttcaccagcgatctgttcggcagtgcgggagctttcagcaactggcgtctgttcgccgatttcgacaagaagtgtcttggctgcgaggtggcccaccccgaacgtcccgacgaacactgcaaggagacggcctcaccttgcccgtggagcggcatgcatcactttcatcgcaaggtcatgcccggcaacaggcaactgcgccacgccatgaaggtggtcaaggccatcggagcaaccatggccgcgccccagcacggctccatcctgtatcgggtcgaggacatcgcagccgccatcgagcgcctgcaaaggatggatgacatcggtatcgacggcattgccgatgccgcatcctgccccgcgtaaggtgccgccatgtccaaactggatgaaatcgatatcaggatcgacagcacgattggcgcttcggtcggaacgctggtttcgaggattctggagcagcaggcgcaactggcggatcaaaggatcaaccagaccctactcaccgaactggtggagcaattcgtggcgtctgaacgccgtcttgccgaggcccacgccaccgtgcttgccatgtcgcgcaccgacgccttgaccggtatcgccaatcgccgctggttcgacgaatcccttgcccaggaactggcccgcgccaacaggtcaaagacctccttgggcctgctgctgatggacatcgactgcttcaagctgttcaacgataattacggccattcggcgggcgatgactgcctgcaggcggtggcccaggcggtgcaatccatcgtcaggcgcccccccgacctggctgcccgctatggcggcgaggaattggtctgcatcctgcccgataccgatgccaaaggggttgaagcggtcggcaacgcggttctggaagcggttcgcggactggccattccccatgccttttccaaggccgtggacatcgttaccgtaagcatcggcggagtgtcgctcattcccaccgaggcgaccacgcccaagcagatcatcgaggcggcggattccgtcctctatgcctccaaggaaggcggacgcaaccgcctgaccatggtggatgcaccaatggatgggtgacgagacttaggaacccggcggggctatccgtcgcctgaaaaccctccgccatgtcatcagcctgcgcgtcgccatcgccaccctcatcagctgcgccgtcttgccggtggcggtgaccgggatcatccggcaatgagctactccccggaaattggacactgacggaagctacgatctgatgtttgctgatccccaactacgaggagatcagagatgtcgaagcgcaggaaccatgacgcggccttcaaggcgcgtgtcgcccttgaggcgctgaagggcgagcggacggtatcggaattggcgtcggcctatggcgtccatccgaccatgatccatcaatggaagaagtccctgctggacggggcggcggagatcttcgaacgcggggccaagaagaaggccgaggtggacgaggatacggtgcgatccctgcacgccaagatcggggagctggccgtggccaacgattttttgtctcgaaagctcaagccgtggaccggcaagtgaggcggaccatgatcgagcccaaacacccggcgctgtcgatcggcgcccagtgccacctgctgtccattgcgcgatcatcgttctattacgagcccttgggcgagacggaggcaaacctggagctgatgcggttgatcgaccgccaattcctggaaacgccgttctatggtgtccgtcagatggcttggcatctccagaacgagggccacccggtcaacgtcaagcgcgtccggcggctgatgcggctcatgggcctgatgccgatctaccagaagcccaacaccagcaagcccgccaagggccacaagacctatccctacctgctgcggggcctgcggatcgaccggcccaatcaggtctggtgcgccgacatcacctatctgcccatgcgccggggattcctttatctgatcgccatcatggactgggccacccggaaagtgctggcctggcgcatctccaacacgctcgaggccgacttctgcgtcgaggtgctcaacgaggccatcctgcgcttcggcccgccggagatcatgaacaccgaccagggcagccagtttacatccttcgcctggatcgaccggctgaagcgggccggaacccgcatctccatggacggcaagggccgttgcatcgacaacgtctttatcgagcgcctgtggcggtccctaaaatacgaatgcgtctatctccatgcctgggaaaccggctcgcaagcaagggccgggatcggaccctggatcaccttctacaaccacaaacggccccacgccgcccatggcggaaggacccccgccgtggtctactggaacaccatcaaccaaaccgatcagcaggcccggagagtagcttaaacttccccgaattctgtccaaccaatggggagtagctcaacctgcggccgtcggtgaaggcgtcggacagaaaatccagcgaccagtgttggttcggcccctgcgggatcgccattggggcccggcaacccagggctcgcttgcggccacgccttgggcgcaccgccagcttctcctcgcggtacagccgcagcagcttcttacggttcatcaccacgccttccctggatagcaggatgcccagacgtcggaagccgaaccggcgacgctctgccgccagttcgcgcaatcgcgcccggatcggcgcgtcgtcgggacgacacgaccgataccgcatcactcgccgggaaatccccacaatcaaacacgcccgacgctcgctcagtccgaacaattctcggacatgggcgacgacgatccgcctggcggcgggcgtcaccatttttttgaggaaatttccttcagcacggcgttgtcgagcatggcttcggccagcagtttcttcagccgagcgttttcgtcctcaagcgcctttagccgcttggcctccgacacctccagcccgccgtacttggccttccatttgtagaaggttgcgctcgatatgccgtgcctgcggcacacatccgctgtcgcctgaccggcctcctgctccttcaggatgccgatgatctgctcctcgctgaaccggctacgcctcatcgttccgtctccttgatgggacggactctacctcaaactggctacattcgaggggaacaggtcagagtcttgttatggaccagtttttcaaggatgccggcagcgacgagaagaaggatctcaacttcaaggttccacctaactttcacgccgactacaaggcgttcgctgcgcagcatggcgttccgatgtcggacatcctctaccgctcgttccaactcttccggctgtcgcttatctggacccactgatggcggccagaatcacggcggcacgccctcaaatgagtgacgtgccgccagaagcctaagcgaccttcttggccttgaggtagtttgccagcttaccgtcctccatctggatgtggttggtcagccaggtcgcaacgtactcgaacatctttgccgccgccgtgggatcgccgctctggaccgcgcccttgtggctcttggcgcgatcgaggaagtcacggtgatgacggcgatgctcgtccagatggggatagctgttccggctcatcacctcctcttcctcacggaagtgacttcccatcacggtgtcgatcagggtgatcatgccctggcccgcttcggcaccgttaccctgggacattttggcgtacagtcggttcacctcgtcaaacatctcccggtgatgcctgtcgatattgccaatccccatgttcagggcgttgtcccagttcagaagtttcacatccgactggtcagagcgaacttggtctaggaagcgcccaacctcggcgcgaaggaattcggactgctgagacaggtcggtggctgcagaatgaatctgctcagccgccgcaccggtatcccttgccgcctgctccacggtcaccacgctggaagaaacttcggcggtacctgccgccgcctgctccacgttacgggcgatctcctgggtagcggcggcctgctcttcaactgccgaggcgacagaggcgctaatctcgcccatctcgctgatcaccttggtgatgccgtcaatggcgtggacggcgttgttggtgccgtcctggacagccctgatctgagaggcaatctcctcagtggccttgccggtctgagtggcgaggtgtttcacctcgttggcgaccacggcaaagcccttgcccgcatcgccggccctggcggcctcgatggtggcgttaagcgccagcaggtttgtctggctggcgatgtcgttgatcaggttgacgatctcaccgatcttgttggcattctcggacagcgcccgaatctgcacgttggtgttggcggcctcatcttgggccctgctggccacggattgcgaccgctctacctgcttggcgatttcagtaatggaggatgacagttcctcggtggcggcggcgacagtttccacgttggccgaggcctgttgggaggccgaggccacggtcgttgcctgggcgctggtctcggcggcggtgctggccatctgggtggaggacacctgtagctgggtggcggcggaggtcaccgtctggatcaccttgccgacgctgccctcgaacgtgttggcgagctggcgcatggcggctttgcgctccgcctcggcacgggctttctgcgcctcctgctcggcctccatttcttttacgcgaagaagcccttccttaaataccccaacagctttcgccatctggccaagttcatcgcccctatcaacgccagggacctcggcagacagattgccagcggtcaactgctccatgcagcccttgatgccattgactggaccggtaatcgaacgtgcaatgacaaaggcgatggcggcaccaagggcgagagccaaacctccaagggtcaagctgaaattgatcttttgactggcactcgcctttccctcctcatactcctcctttgcaattcgctcctgcaactcgatattggcaacaatctgctcatcaaggtgcatgaacttctgtagcgcaggcccatttgccagggatgtcgccttgtcggggtcatttgcctttaggagttcgatgaccttgtttttttcagagagataatccgggagtgctgtcttgatcttgtcagcaatgactttctcctctgccgcaagttctgttgtaagataggccttccactccttgtttataatctcttccgcatcggcaatttgtgccaccatggtggcgtcatatgcattcagatcgagcatcttgagaaggcgcacccgaatacggaaaaggtttcgctgcatagttcccaattggacaaggcaaaccgtccgatcctcgtaaaccgtatgaaggctgtttaggatactcaacataccgctccgtccgagaaatatcgtagtgacgagagcgatacagagtactccagtcaggatcgacaggcgcatcgagatgcggagattggatagtgacatggcgcgcccccaaattcggattggacctcgaacaaggatcctatccaatttggcatatgccaacaatatgtgatcgatgcagctcagccctctgtccagtgggacatttcatgccgcaaggggatgacgctttggtatatcatatggcataatgtagcactaccttcgtattgctgccattggcgagccgctggaggtctcaacgcgggtaggcggttgatttctgcgcgctttctctcagaggagactggccgtgtgcgaggtccttaatgccgcgcctgttagcgtgaaggctgccattcttccgattctggtggagtcaccatttacttcggctatcgcgtgctgcgcggagttggagcgaagagggggcgacttacgcttgatcgccgagatacgtcagtgggcgattgaaaactgccagggctgttgtgtgtgcaatgcaactgccggccctcttcatatgtcatgatacgcttcatatttcagatctgtaattccctccccagctgctttggctcgatggcgatttcggcggccacactcccggcacacggcgcagcctgtaggattcgaaccgacgaccgaggccgagggagggtgttgctccgatcagcaccttcccccttcccacaccggcggccttgcgctataaacctcgcctctcgtttacccgagacccgcgcagccgtagctcagctggatagagcgctgccctccgaaggcagaggtcctgagttcgaatctcagcggttgcgccaatttctctatattttcaatatgttatgatgcgccccaggagcgagggggtaagcattttgtcttgcgtccccaaagcgcccccaaaatatgaccagttaagccaacgacaatcttgttcaacgagtatcgatcactcgcgatcttgatcatgctggtccaaccatcggcgcatctccaccggcgcttggcgagggccgacctgacacaaacaaacgggcacttcaatccagtcatctgcgatatcgagcaaatggtcgcccccctggatcacggcacctccgacggtcaccacgtatttttcatcgtcggtcattttaaacctgaccgcgaaatcctcaatgtcgtcggccgtaatgtagtatgtggttttcaccggatacttggtgtctcgctcctgtggagcgctttcagatggaggcagagtcgaccgaatcatctcaatatcatcgggtgcggttgaccagagggtaaatgcaccatatccaaggcggctattaaacaccgcgtcgaggtgcttgggggtgacctctccgccgccgttatccgtgacggcaatcctgcctttgcatttggccaaatggctctgaaagtaggtgtagccttcctcatcagcggccaatgtgatgcgccacgggtattgcttccccagcgctttaagccgcctttccatggcggcctcggggcgatcctgtcggcgaccgacaaatattcggcaattatcgttattaaatactttattcatgtccaacctccaaatatatattcgctcaacaaagcatcgatgtgcctgcccagcgcataatgcaattattgcatcacaatgattatttatgcaggcacacatattttgtgcgacatgcgtattcatcgcaatgagaggcgagtatttattggtgatagaattattgctttacggcttatccccttccctccggtaaccaccacacccaggggtgctgaggctcgacatccccgctgatccgggtgacgatggcggaggagaggctgcatgtggaccattccgacctacatcctggccgcgttcgcggagatcggcggctgttttgccttctgggcgtggctgcgcctggataagtcgccgctgtggctggtgcccggcatggccagcctcggccttttcgcctgggcgctcacccgcatagacgccgacttcgccgggcgcgcctacgcggcctacggcggcatctacatcctggcatcgctgatctggatgtgggcggtagagggcactcgccccgaccgctgggacaccatcggcgcggcgatctgtgtcgtcggcgccatggtcatcatcttcgggccgcgtagcacctaatcgatcagcggcaacatcccgtccgccaccctggcgtttaagctggacgggcgggcacggcaccgctcagagaccgaaggaaattggctgcataaataggcattgatgggcgccgccgaggcgatacgcaaaggtgcgtgccaatgaagaagcgcactcatgcggtttattaaacacaacaaacaataaggaggtgaaaaaaatgcaagttatgaaaattacagttgatagcaagagaagggatgctgcatgccattggttacgaaaacattttggcggaaagtcatatgaatcatggttccagaaaatgccccacatagggcgctatggcgaactcgtggatgacttctatatagcagcagaaaataaaaggtatctatcatttttccgaatgaagttttctgatcacagcgttgaaattgttgatctgacgccgcaactacgaacgctttgtaatattgtatatattgatgatgtgctccacatcgcaggcggccctcctcccagcaatgcggaagtcaaatacttttgtcatatgcagccactatcacttgaccacttaaccaacctatctgaaaagatcaaggctatcgccgatctgtggacagcttttccggcaaaggaaaacgatgtcaatttaattgcagaatgcttcagagagattgtgtcaaaaaatgcacttaaaaatgttgatgttgatcggatgctgctgagaattaaaaggaagcttcatcagtatattcactacaacaatccagaaaaactgctctggcagattgggtggcagctaactgataacctgatatttgactgggcacattctcttgaaatcatgatgcatgtcgttgcccttgtccgcccgtttaaaatgctcggcgggatcaatttccaggtcaaagagtatcaacgtaaaacatggcggctgacatcaccaaaaatgcccgctcacttgaaatccatcagtggtgctgctgcataaataggtagtaggccatatggaggtgatgaatatgagattgaatgaactaatgatttctgccgctgatgcggtgtctgttgagagaaaatatcaatgcgataattcgtttttaggagatgatgctgagttgggctctggtctattggaagttcttgacactattaaagctgcgacgcattggacagaacatttggtgagtttgctcattatgcgtgccaaccgacgggtgatagatcgcggtccatccaagtgaaataactacatgcctaaatacctctgtcgtcagttccaattttcgacgaaagaggtggtcactatgaatatatgtatcgcattgaatacttttacttgtgctgcgccacctcccagcacatggctcctggcgtattggaacgcgccaggggcattttttgaggtggtcacatggaaaagaatatatcgcagccagcaattggttcaaaaagcaaactcccgagaagttggcagttttttcgttcggttgagcggtcaaaattagcgtttgccactataattatcagcgggatacgcgtcagccagagcgcttcagaggcggagattgagtctaaaatcggggcggaaattgagctatttaagtcagattgggcaagtctaaccaagagccgtcgtttgcccggcctacgatttcgtggtgcgtttgagtttgatttatcaagaagccgggatgttcacggtcaccgagaatcactatttagcgatatgggcgttcaaccactcgtgggcgatgacattatcatcaatctgcatgtccacatgctgatagcgtgtagtcggtgcgatgcagataatctttcagaagaattgcggcgaaaatggccgggacggtggcgggtggtcgtcaagtcattgtttgaaaatcaatcaactgacgaggcagtcagcaatatatatggctatattaacaaacaaatatgccgatatgcatctggtggaattggcgatatcccagtcacctttgggaatgactgggagcctgtttggttaaaaaagattggtagactttataaatgtatgtcacttgagtttagatcatctgacagatggttgtataatatataactacaagaccatgaatgcctgatcacagctaatataattacacaaacatgtcgcatatgtataattgctaataaataatattctgcatcgtgctgcctgcataaatattactacaacatcatatgcaggaggcattctatgctaaatcttaaagatatttacgatgaacttcactctctcggggtggttgggtcgggtcgcagctttggtgattttgcaaatcgcagccaaagttatttgagttcatccctgtcccgttgccgccgcccatctgccgaggttcttctggccctgatacagaacatcaacgattgcctcgacgccactatcgaggctgcggcactgtccaaaagcgatgaagatcgaggcgaatacgagcatggaatcaatgggttaaaggttttagaagccagagtatggggagaaatatggcaacgggccggtagccgaaatggctattcggccagcaaccggtaaacgctggcccgcccgacccccagcttgcgggcgatggcagccgccccaagcccctcgtccttcagggcacggatttcctcgggctttatcgtcgggcggcggcccttgtatttgccttcggccttggccttggcgataccctcccgctggcgctccaacatgatttctcgttcccacgcaccgatcccgccaagcaaggtaagcataagccgtcccgtcggcgtgcttgtgtccatcgccatgttgagaacccgcagggccaccttcttctgttccagatattcggtgatctggaggagatgagggacggatcgggccagccgatccaacttgctcaccatcaggacatcgccctctcggacaaactccagagcggcagcaagctggtcgcgagcagcaacatccacggacgaaacttgctccgtgaagattttttcgcaaccggcagcttccaggtctcggtactgggcatcaaggccggcccgctgatcaagagtggatgttctcgcatatccgatcagcatagcggcctcatgtcttgtttgtatttaagaagcatatgggaatatgtctcaaatgtcaaattggcacatatacgagacacttatttgggcggatttcggtgccttgctgaaccttgctcatgcgagacgcggggtttcatgtccctggcacaggcgcagcagcgcctttgccgcctgagcttcggtgggcttggtcgaattgatcaggctgccgcagaggcatcggtggcgggtaacccgctataagcctgaactaaccaaatcattcactcaatgggcgtcgtcatgcccattgcgaacaggagaaatgtagtcatgacaacccaaaaaccattcgcaactataactgccaacctaatcccgaccatatactcccaagcccacatggtagcgacatgtgagattgatgatatgttcgagacttgtgtttgtgaattgaatgacatcaaggacacttttaaaaaacaccacatacacgccataatgtgtatctttaaaagcaatgaaatatacctgggggagacaccaactccagatggtttcaatcgttactatgagcttcctgttatataccactgcgttgtattcaaaaaaagaagcgatgcagttaagtttagaatggtttgcgatgatgagacgtgggccttgaataaaatatatgtcattaaacgcggcgacacatacctttcggtaaagaataggatgagtactatcgtcgatgatggagaagacagcgatatagacgatgacttcccagctcccgttccggtttgtgttgaatgggtgcgggatataaacaaagcatatcgttcatacactacaaatagtattcttccgagacttgttggtgcagaatatgtggcatttaactgcaccaatggcgatctccacaccccagtgggctgatgccgaaatgcctccccgcttttgcaattcggggacttccactacctgctaaacgctatccaggcagctctcacgctgatctaaaaccccagaacgtctgctgagttacccattatcacgcgccgggcgaatcatccccggcgcgaacaggagagatttgatcatgaaaatccaaaaaagcatcgctaatataacatcgacgctaataccaaccatctattcacaaggatacatgctggctactgagctttatgaagatgaatgtgaatatgaaaacattatggagacattaacaaaacaaaatatatacgcgacagtttgtcatttgacgagccatgagattggtttgtggcgaatgggtgttgctcggtatttatatgattattattgcattgtgttcaaacgcaagagtgatgccgttcgcttcaaaatggcttatagcggggactgctatccgcttgatatggtttatgtgatccggcgaggaagatgctatctaacggtcttggatacagattttaatacaggtcgcgtcaccgtcggatggacatgtgatgtcaacaaggcgcatcgatcatattcaaataatagcgatattatagatatatttggtgccgagtatgttgcatttccatgcactaatggtgatctttaccatcgtcatagccatgagacactcgtttacgcttaatcaggctgtaagcgtgcgaattgactcatactggcccggcgtgccgggccggtgtggtcctatctgtcaggtgatatccatctcagcacacacaagctttgaacggctcaaggggagcgatgcgtcattgccctcccgcagcgattttcaatcgggtgatcgccatttcaagttcggtagcaatcttgcggcgtaggtcggaagccttggcctccttcaaccgccgcaaagagccctcagcctcgttcaattcctgcacggccactgtggcagactgggttgctaaacgcagcttgaccgacgagatctccgcagccttgccatcttcataagccttgtcgatggggccgctctgggccagggctattggtgcaggggtcagcatggccgccaccatcatcaccatcagggtttgcttgatcttcatgtcgatctccttcactgggttgatgattatgcgccccactcccggaccagcaccaccagggccgagcgggcggcgcggccaatcaggctttggccctggccgctgatctggacatggccgatcagcttgaggttgggggccgtgccatccagacggatggtaacgcggaagaagcttccctggggcaccagaatctggcccgatacccgcacggggatgtcgccgccatggagcgaggccagggccggatcggtcagcaccttgatcggattacggtcgatggccagcaccgtgccggtcataccgacatggtcgaggccgttggggatgaaacgggcggtgtcgcccggcttgatcctctccaggtcatcctcggccacataggcggtggcgatggtcgaaccatcaacacggatcagacccaattgctgcttgggcgacagccaagcgccgggcttcagatccggcagtggatcaaggaagatcccggcatggggcgaggtaatggtcagacgttcggcctcggcatccagggccgccttctcagacccaagccgcgatagttcctcggtcagggccgacaggcgttcccgcccgaagggatcgagcttgaccgcctccaactcggctgattttcccgccagcttggcggcggtgatggcacgccttgaatcgatatcgggggcggtgaaggccagcaactttgttcccgccgccacatgctggccgcgctcgaccagcaccgcttccaaccgggccggagcgggcaggaatagcggcgccataatctcggcggcgaccgaggccggagcctcaatccgggtccgccacgggatgaccgcgaccaccaaggcgaggccgattcccagcaatggtcgcttccagcgggagttcttgaaaataccgtcgcggcgcttggcccattccttgacctcgttccagatgggcaggaacacgaaccagccgatctcgacggcaaacaggagaacgcccaccgccttgatgaagaagtgatagaccagggcggcaatgccgaggaacaacaccagccggtaaatccaaacggcaaaagcaaagacgaccatggcccgctggcggcctgggttcatggcttccggcggtggctcgcccagatcgaacaacacttcccgtagccaccacttggccatggcgaaggaacgcggatgcaggttgggcaattccagggcgtccatggcaaggaaatagccatcgaatcgcatgaatgggctgagattgatggccagcgacgacacccaggtgaaggcggccagcacaaacaccgcttgtcgcatgccaccgtcgggcaggaatgcccagagcagcgtggcccaggccgccaccgagagttcggccaggatgccagcggagccgaccagcaggcgctgacgccgcgacgccaaggtccaggtctcgttgacgtcggtgtagagcaccggccacatcaccaggaaggcgattcccatggtgggaacccgacagccgtagcgcttggcggtgaggccgtgggccagttcgtggatcaccttcacaaatgacaaggcgatgccgtagctgaccatgccggaaagcgagagggtatcgaccagggtggcggtgaagacctcccattgccgcaccaccagcatcaacccgagcaacaaagccccggcactggtccaacgaaaccactggctgcccagccagcacatcagcggcagcatggcccccagaaaccggtcgggccgcaccagcggaatgcggaagaacaggtaatggtgcagcagccagttgaagacggaatgcttttccgtcgccgcctgctcggccagccgcagtgtgtcggcatggctgttggccagggtcagttggttgccgtggaggaacttggcgacatccaccacctcctcatcactcatgtcgatggtggtttcagaacgcaccgccttagcgacgtcaccggcggtgccaccccagcggctcagcgcctcgaaggcggcccagccgatgcggaaatagcggtttcgcaccggatcgcggatggtccaggtgggcgagccgtcgaggctggccggccccggatgcagcgatagctcatcgcgcaaacccggcaatggcagggcggctgcgtccatggctacagacccacaaagttacgcacgaccgccagcgggcgccgcgccagccagtagatcaacgccacccgatggccgtcgagtcgggcggtgcctttcaatcccaaccggggaccgctgtcgcctttggccaattccgcccgcacccgatgacccagggtgccgtcgggctgggggatagcttcataggtgacataaagcagccgggccgataccggcgacagcggatcggcattgagaaacaggctgaccgggtcacccttctccaatgcgatgacatcggcaggggccaaccaagcctccacctccacgtcatggggcgatgccaccgccagcaccttctcgcccacgttgaccgggcggccctgccattcggcgggatcatccagcacggcgacaccggcgcgcggcgccttgacctgggagcgggccatcaagtcttccaactgcgccgcctcggcgctccgctcctcgatgcgggcacggatgatggcaagctgccccttggccttggaatcgaagaatgcctgctgggtggcctgatccagttcagcctgagcggtggacagagctttctttgccacctccagcttaccggtgagcgtggtgcgatccagttcgaacaggatgtcgccctcacctacgggctggttgggccgcacatgcaccttctcgatgacgccgtccatgggcgaacggatcaccgccggattgtgggccaccacctcggccggggccagcaccgaaaggcgcaccggaaacagcagtgccagcacgattcccgccgccagcttcagccggtagcgaggaatggatgtgacttttcgcttccattccgtcaccggcgagggccggtgcagcacggcccaagcatggccgtagaaatccgaagcacgggtgagcagggcaatgtcctgctcgccccaatcctcgtcacgggcgagcagcagggttccgagtcgcaggccgtcgcggtccttcaacggcagtagtagggcatggcgaggcagccactccgaccattctgccccatcggcgccatcaagatcggcggggcggacttggcgcacatcatcggatgccagacgcttgaacacccgctccaaccacagggtaaacggtgccccggcctcgatcccggcgactcccgataccgccttcagaccttcaccgtcgatgaacagcgccgcttggcgatagaaagccagtgcccggctgtcattgaccatgacaaagccaagttcggtggaattggccgccttcctcgcgtgctcctccagccccagcaggttgatgagcgggttgtcgctcatggcgctggcatttggacccggcctgtcataccggcgatcagttcgggatagtcgcccttgacctcggccaccaccttgaccgaatggctgaccgcatcgaccttggcgccgacgcgagcgatcttggcggggtagaccttcttgacctcgtccaccgccacctggaccaccagaccgggtttgaggttgcgaacccagccggacggcacgatgaactcggcctccagggtcgaatcgtcgaggatgtcgaggatcggttgcccggcctggacatattgatgggctctcgccttctgctcgaccacccggccggagaacggggcggcaatgccgcatttgctggtgacggcacgggccgagttgagcttggcctgggccacggcggcgtcggacgccgacttctcggcctccagcgttccggccgagttaagctccagcaggcgcttatgcaccgatttggacttttccgccgcgccaagcaccgcctgggcctcgtccaactgcgccctttgaatgacgcagtcgaaacccaccagggtctggccctccttgaagcggtcaccttccttcaccgtgatgcggtcgattttgcccggcaattcggcagatagggtcgtgaactgcaccgccaccagttggaccgggatcaccggttcctgagcttgtgctccgaaggacagcaggcacagaaccgggaccgtccaccccagacggatcgagaaaatatacgtggcgatgacgttgcgcatcatccccaccgcgccagacgggccatggccgcatggcgaccggcctgcttgagttgctgggtgaaggccagcttgccagtatgatgaagatcgccagttcggagcggcttgccgtcacgcgatggggcaaggtcaccgttccgttgtccttgcggagcaggattgtcacgatcctgagccgagggcttggcgggtgcctggccttctgtgacggcgccgccacctacctggatgcggaaggtggtggcgacttcgtgcccgccgttgtcgcgggcaaccacgaccaccgccaaggatcccttaaagccctcgggagcctcaccgacgaagacacctcgcgtcgcatcgaagctcatccaaggcggcaaggggcgaccatcgctcatcttggcggcaagttggatgccagcctctgcgctggtatgaccgaaagcatccacgggcacggcgaaattgatgaccttggaatccatgaccacggcaggaatgcccttggcgacaaacaacgcgccgtcactgacggagttgaccggtggcgccgacaccaccacctggaacccaccaccactggtcacggaagcgatccgggaggtaaaggcattgctgccaagaccggagcttccctgggtgaaagcgccattatccgagaccgccgcccggatcgacgtaatcaatgccggtccctcggacgggggaggtggtggcggcttgggagcctcgacgaccggcggtggcggcggcggcggcggaggtggtggtggcggagacggattgttgtaactgaggttgatcacgctggacaccgcagcccccgacgaatcggtcgctgtcaccgtcacagccagggatccattggttccctggggcggtgtgccgctgaaggtctgggtggtcgggtcgaacttcagccaggacggcaagggcgtattgtttggccccttggcggtataggtcagcggatcactgtcagggtccgagaatgtgccagaggggatcttgtaggaaccgccgctccccagcgagcctccacccggtgtcccagaggtcggtgtgtcgttggcgcccgagatcaactgacggaaggtggtggatttgctgccaccgttgccgtcagacgcggtgatcttcaggtcgatataggacaggctgctgggcggattgccgctgaaggtgcgactcgaagcattaaatgacagccaactgggcagggccgtaccgtccgccttggtggcgctgtaggtcagggtgtcgccgtcggcgtcgttgaagacgttgctgttgaactggaagctctttgccccggaaccactccagctttgctcggcgatggcattggccaccgtgggggtgtcgttggcgttggtcaccgtcaggttgaaggtggaactgatcgacccctgctggttatcggtggccgtcaccttcaaagcataggtctgaccgttggccgaggccggtggattgcccgagaaggtccaggtgctggtgttgaacgtcatccaggacggcagggccgcgccgctggacagggtggcgctggcactcagttggtcgccgtcaccatcggcgaaggtgttgcccggcacctggtaggtccagcttcccgccccgtcgaaggtctgggccggaatggcattggccaccgtggggatgtcgttggtggtgctttggtcgatggacagcaggaagctggtcgaggcagatccgccattgccatcggacacggccaccttcagggacaggttgggcgccccccaaggcgggttgcccgagaaggtgcgggtgttggcgtcgaaggatagccagcttggcagggacgagccgtctgtttgggtcgcgctccaggtcagcgtatcgctatcggcgtcggtgaaggtgttgctgggcacctggaagctccaggcgcctgggccactcatgtattgcgggccgaccggattggccaggaccggcacgtcgttgacgtccgagaccctaagcgtgaatgtgctcgacaccgccgccgccgacgggtcggtgccggtcaccttgaggaccagactggagacgctggacggcggattgcccgagaaggtgcgggtgctggcgttgaaggacagccaggagggcaaggcagagccgtcgccctgggtggcgctccaggtgatggcatcgccgtcggcatcggtgaaggtgttgaccggaacctgatagctccaactgccggagccgctcatgctctggtcggaaatgccattcgccaggaacggcgtgtcattggcgctggcgatggtcaggttgaaggcagtcgagatgctgccaccttcattatcgttggcactgaccgtgatggcataggtctggccatcggccgaagccggtggattgccggtaaatgcccaggtctgcgggttgaaactcagccaggacggcaaagccccgcctccggtcagggtcgcggaaaggctgagcgtgtcaccatcggcgtccgtgaaaacgttgcttggcacctggaaggtcttggagcccgccccggtccaagtctggttgctgatggtgttggccaccactggagcgtcgttgctggtgttctggtcgatgttgagacggaaggtggacgaggcggagccgccattgccatccgacacactgatcttaacgtccacctgcggtaggttattgggggcgttgcccgacagcaccaaggtgccagcgttgaacgacagccaggctggtagtgccgagccatcagccttggtggcgctccaggtcaatgtgtcattgtcggcatcggaaaaggttcccgacggcaccgtgtagctccacactcccggccccgaaatggtctggggcgacaacggtgtcaccagcacgggcgcatcattggcggtagccagtgtcagcacgaaggtatccgaaaccgtgccgccattgccgtcattggcggtcaccgtgatgttgaatggccccaccccggcgggcgggttgccagagaacgtgcggctggcggtatcaaagctcagccaactgggcagtgccccgccgccctgcaaagtcgcagaataggtcagcgcatcgccgtccggatcaaccgagaaggtggctgcaggcacctgatagctcttggcgcccgatcccgtccaggtctggtctggaatggcgttggccactgtggcggtatcgttggcgttggtgatggtcagcgtgaagtcggcggttccagtgccgcccttgccgtcgctggccgtcacccggatggccaagctggaaacccccgccggtggattacccgaaaaagtcctggtcgaggagttcaaggaaagccaggacggcagtgtcgcgccgctttgcagcttggccgaatagctgagcgtgtcgttatccgcgtcggtgaaggcgttgaacgtataggtcttggcccctgaaccgctccaggtggtaccggcgatggcgcctgtggggttacggttgacggtgatggcgaaggtggtgagcgccgtcgagcccgaaaccccatcggcgaccgtgaaggtgaaattgtccgaggtgccgccgccaccgccatgggtataggtgatcaggccggtattgacgtcggtctgggtgaaggtggacccggcgctcaatgcaacgttgttgcggtaaagagtcccggcggccggagccgtgccgacggtataggtcaggctgcccgccgcctgctcgccgtcataggccaccaaccgggtggcattgatggtaaccgactggctctgggtgacggtggcaccctcattgatgctgacggtgggcgggtcgttgacattgctcaccgtaatggtgaatgccttgtcataggtcaggccgccctgatcggtggagcggacggtcaccgaatgactggtcgccgtctcgtagtccagattggccccggccttcacctgcaactggctgcccgagatctggaacttggatgtggcccctcccaccagcgaataggttaaggtgttgccgctgtccgggtcggtggtcgtgagattacccaccaccgtaccggcgccgctgttttccggaaccgtcgccgccgacagggcgatattggtgggcgtctcgttgacattggtcaccgtgacagtgaacgccttttcgtagaacgctccttgcgcatctgtagtgcgcaccgtcaccgaatggctggtcgccgtctcgtagtccaggttggccccggacttcacctgcaactgactgccggaaatctggaacttgtcggtggcgccgcccaccagggagtaggtgaagctgtccccgctatcggcatcggtggacgacagagtgccgaccgccgttcccgccgtgctgttctccgccacgctggacgcggacagcgagatattggtgggcgtgtcgttgatggaggtggagataaccgaggtggcgtagtccgtaaccgtcgaggccacgccatcactgacggagatggtcatggaggtggtctcggtggaccctaccgcgacccggttggcggtgggcgtgaataccagcccccggatggccgtggtggccgcagtagccgtaccgctgaaggtgtagttccctgcgccctggttggtgaagccggaaagcgtgctgaaatagcccttgagagaattgcccagtgcgatggttaccgtctgggtctgcgcagtggttccatccgacgtaccgttgtcggcaatggtcacattggtgaacggcgagacggtggcattgtcgttgaccgtctgcccggcactggcgccggtgatggaaggcgcgtcgttgacggtgatattgaaggtcttggtcgccgtcgccgtgccgtcgctcacctgaatactgaaggtgtccgtgccggtgtagcctgcggtcggcgtataggtgacggtaccggcgggcgtgatattggcgctgcccgacgatccggtgagtcctgaaatgctcaacgttccatggctggggccgctgctctgggtcaaggtctccgtctggccggaatccgtatcactgatgtggaggtaggatttcaggtcggtggcggacgcacccacggccacggtgaccgactgggaagaaccgccgacaaacgagggtgtagtgttggggtttacggacagcgacgcacttggcgcaaagttcgcagtatttgattgcgtatccctaacttcgatataccacatgctcaaagtgccggaatacgtgggaacaaagttctgcccatcagaaaccttgtataacgtgaccccaccgccaatgtaatccgttgttctctgattgctactcccatcaagttggggagctgtgacattgataaatccctgacttccttttaagcttattgtgttgccaacttgcggcccagcagtatatgtataatttgcataataattcatatcatagttgtagtttgccgtaaatccaacgtaagtagtataccaattaaaattattacctacacttaaggttccattggagttatacgaaagcgccaccgaatctgaagtgcgaacccagctatataggtatagattagcgtcatagctgacaagaagtgcgaaactgaacgggccatcactattcaacgctccggtgacggtctcaagattccaattcccgtctttaccggttacgtcggtggatgccgccacatctgcaccggtggcggctgccagatcattgacaaactgctttccatcgtcacccttggccacgtcacagccatagagcaggatatcgccgtccggggtcagactggcaccgatctcagccagtttctccctcgcctgggcatcttgcaacgtagccaaggaaagagaggtcaggccgatcttctgcacgccatcggcgccgtggccgagaatagcgatgctgtcatagccagaatgggtctccgcccacttgaccatctggagcaagccgtccttagaaccgtcgatctctacgacgccgacaccgtccttcaccgccgcttccagggtcttgtagtcggcaaccgaggtatcgacgaacaccacttccttgcggccattgttccggctggggtcagcggatttcacttccactggagtgggcgtatcgggtgccgctaccttggcaagggcgtcgggggcgtcgggggcggcatggacggtatccaccgcagccgctccatcgaacatccagcgcggttccaaggccataaggcccaggttcattttctttcggctgcgcttgatggcgttcatgattgctcggtcctagcttttccaacggattccgacgggttggaatgcggcaacttcctggtcaaaatcgcgatgtccttcaaggaaagctgcccatccgacctcgtgggacgatcaggatctaaacggcgaagcgtcatccggcggatggcattcctggctgcacgggcgaggatttcaccgatcatcgtcgcctccccgatcaggaatgaagggaggggcggaggcgagccagtgaccaaagtcttggatgaagtccattccgcccctcccttttggcgcgataactggggccgcctaccagttgatggggcgccccaaccagtcgatagggcgatctggcggattggcctgagcgacctgggaggcagcgggatcaacggtcacggaaaccggcaccgtcacgggcggaggtgcttggacagtcggagctgtggcctccttggtcggggcggagagttcctggaccttgtcggcaatggtgcggcccaaccagcccagagcatcggcaaccacgtcgcgctgttcaggttcggtcgaaacatcaggcttcacggcttcgatgacggcgggagcggcctgcggcacggcatcgaccttcaccaccggcggcatggccaggacgatggctcccgacaagccttccagcgagtgcgacgccacccgctccggcaccggatcggcgccgatggtggcttgcagcttgccataggccgactgcatctgggcataggtctggaaacggcgtagttcggcggcgatggccgaggtctcggtgctgatcctctcgatctcgttctgggtgccgccgcgctgctggttgcccgaggcttcggccagacgggtctcgatgccccacagcttgtcggctcgctcgaactgcttggtggcgctggcgaactgatgcgagatcacatggacctgggccaagaccgccatgcgcaacgcgatgcgcttggcgtcggcaaccttctcggcactgtcggcatgggccagccgatccggggccgatagcaggttgatcaggttccaggtgaccttggtgcccacatcgttccagcggttctccatcaggaacgagttggaatcgtactggcgcgagaaggacagcgtcacgcccggcagcagcttcaggatttccttgtgggtatcgtcaatggcgatgcggctctgataatcctgttcccgtagatcggggttgttgatcagcgccgcctcttccatctgctcgatgggcatgtcccaggcggggatggtcatgccgcccttttcaggcacgtccagcttgaagtcgctgcctggcgccacgttgatcagcgccgcaagctcggccttggcggtggtcagctcctggtcgatggcctccaactggcggatgctttccagcagggtcttttggatacgaagcgtctcggtggggttcttcagcttttcggcctcgacccgctcggaatccttcaacgccttttcggcattggcgatcacctcggtgaccttgcccttcagggtctgggcggcggcggcccgccagaaggtgaagcggacctcctggaccagattgttgacggtcttgcgccgcttttcctgggcgatgagcgcccggtcggcattctggtgggcggtgaagtagctgacgccgaaatccaggatgttccaggtcagacccagatcattggtgatggaaaaacggtccgccgaatagctggggttcgaggtgctggtggtctgggtatacagatcccgcgaccttgtggcgttgggggccgagcgctcggtatagcccgcatttgccgccagcttgggcagaaggtcgaagcggtcgagactggtctggcccagcgccagggcttcgtccatcatcttggaccgcttatccagattgtacttcagcacgcgggccaccgcgtccgccagggtcaacggcttggccatcacctcttggccctcgaacatggcggcgcggtcggccttggccttggccgagaactcgtcggcggtgaacggcgtcggtgtcaccgcgcaggccgacagcagggcggcggtggacacggcggccatcaggcgggccaagcgagacagattggcggtcatgtgattatcccctggtcttaggaaaagcggatggcggcgttacgcgcggccatcttgagttgttgggtgaaggcgatcttgcccgtcggcttgtcgcggaggtgatggcccagcttgatcacgttgctgtcctggacggccccggtcttctcgggtaggccgttgatgcggaccgtaatggtggcttcctggcccttgtcgtcgcgggcgacgatgcggaccaccatggtccccttgaagtcggcgggaggctgccccgccaaggtgccggagcgcgagtcgaagttaagccacgacggcaggggttgccccgtcacgcgagccgcgctcagtgtcaccaccgcatcggaacgactgtggacaaaggcatccagcggaatggtgaccctcatggggccatcggtaagcggaggcacctgaacctcgggacgcagtgcgagcagcccttcgactggcggcccaccttgggtggcggtcaccacgggaacgcggaatccgccatccgatgcggtcggcgtgaattgcggcgtcatcaccaccgggatcaccggcggcgccaccaccacgggagcaagcggaaccgcgaccttgggggcttcgcccaccggcgttttcggggcgtcactggtcggtcctgccgacggccccttgggggcgtcggaaacaggcggcgcggccggtggtgacggaggctgtatcggcgcgaagacgggtgtcggcgtggtatcacggacaatggtctttggcggctcagcgatgggctgaggctgaaccggcggagccaccaccaccggcggcgcgggcggcgcggacggcggtgggggaggtggtggcggggccggatcggcaggcttggccgcaatcgtgatattgaacacccgggttgctgtcacggtaccgtcgctgacctgaacggtgaaggtgtcggtgcccgaatagcccgtggtcggggtataggtgatagtgccgcccggcgtcacgtccgtggagcccgatgtggccgtggcactggaaaacgacagggagccgtgactgggcgccacactctggctccaggtctcggtctggctggaatccgaatcgctgatgtgcagttcaggcttcagatcgatggcggcgctgttgtaactgaccgacagggtcttggcggtggcagtaacgaaggtgggcgagacattggacgccaccgtgacgttgaacactcgcgtcgcggtgccaccattgccgtcgctgacctgaaccgtgaaggtgtctgacccagaatagccggtggtcggcgtataggtaatggtgccgcccggtgtcacatccgtgctgccggatgtagccgtggcgctggaaaacgacagggttccatggctgggcgccaccgactggctccaggtttcggtctggctggaatccgaatcgctgacgtgcaggtaggatttcagatcaacggccgcaccgttgaaggcgaccgacagggattgtgccgtgccagtgacgaaggacggcgtggtgttcggctgggcgctgcgggcggagaagtagagtttgttgttgtagacagtgatgctggcgatgttgctgcccgacgagccggaattgatgtccttgaccagagctgttccgccgctggtgccgtcgcttttccacaattcggcgccgttgctgtcgttgagctggaagggggtgaagtagaaattcccccccatcttggtgaggtagaccggcatggcgctgctactgccagaattgatatccttgatcagaccgagggacgttctgtcccagctcagcaattcgttgccgttggtcccatcattgccgccgagatacatagtggcagtcgaggactcgaacccgtaaacgctggaaataccgttaaccttggcggttccggcggcagtgccgtcggtgctgtacagatcccccgattgggtagtgaagtagaccttgccgtcaccggcggtccattggaagaagccgccggaagcactcgaattgcccgacgcgggatatccggcagtggtgcctccggcaacaatgtctttcagcaggatggttcccgccgtagtgccgtccgaaacccagggctcggccccgtaggtggaggtatagggtgagaaatagagtttgtcgcccaccgtgctaaacgaaaaagttgcatatgaagtgttgctccagaccatgctggcggagccgaaatccttgaccgccacggtaccgcccgtggtgccgtcacttttccacaattggtcatagtgccccaaattggtgtcattggcggccaggaacagcttgtcactggcggcgatgaccttggatacccagacggtatgaacccgggatacggtggttccatcgtatgaccacagttggcttccggcagcgctggaattgccgacgaagtagagagtgttgttgagcgccgctatcgtctgcgaggcccccgtgctgacgccgccactgctaccactccacagatcggtgaccatctgggtgttggccgtggtgccgtccgtccgccacaactcggccccattggtgccgttgttggccgcgaagtagagccagccgttgcacaccacgaactgattgtagctgctgttgaaggcatcgctgctgccgggccggatgtccttgaccagttgcgttcccgcctcggtgccatcggtgacccaaagctcgcggccgttggtcgagtcggtggcggtgaagaagagtttgccgttgaagacgatcagatccttcggattactgctgctccccggattgatctccttcaggatggatgtcccacccgaggtgccatccgacacccagatgttggtggtcacggccagggcggcggcatagtcagggacatcaatggcggaggaagtgatggttcctgtgctgcgctccaggcgccagtcgccattgcgaccggtcgtattgtccgatgcggccacatcggcacccgtagcctccgccagggtctcgatgaagtgctggccgtcttctcccttggcaacatcgcaaccatacagcatcaggtcaccgccagccttcaaggcatggccgatctgggccaactcggcctgggtgacagcgccggaaaggttggaagcgtccagggtgtcgctgccgagtgtcagcacgccttgcgagccatgggacaggatggaaatgctgtcatagcccgattgggtctctgcccacttggcaatctgggccagaccactctgaaccccactgatttcctggatttcaatgccgtcaccgaccgccgcttccagggtcttgtaatcggcaaccgaggtatcgacgaacaccacttgcttcttgccgccatcctgggactgatcggcggcccgcacctgcactggggcgggagaatcggggattagcgccttggccgccgaatcaggtggggcatgagcggcatccatcgccgcagcaccatcaaacatccatcgcggctcaagagcaatcaacccgagattggggcgccttgaattgttattatgcaaatccattgccgcagctcctaaatacccgatacaggcattttccgctgccgactttatcagtctggctcctgcacctcatttgtcatgcaatacccggtcgagacgacttcgtaccaagtccggcaatttggtccgcccacgtgtcttcatctatggacagcccgtgcagcgccacgtattcgttcaaaaagactattacatcgggagggggagatgcggcctgcgtatgagacgctgaagttcgattggctctgcacgccgaccgccgaagacgcggtggtcttacgcccctgggacggggatctggcgatccactactatcccgttcccgaggaaatcgggcaggcgcacatcaccaggctggaactggccatggggatgacgatttttagggccgagcaccagttttcccaggagggcttcggaaagctggtcgaaatcgcaaaggttgaggggacttttccgtccacctcattcatggttcagatcgcgcggggtagccgggtcatccactacgaatccattccggctgtgaatgtcattttcagcccaggccaggatctgttccgtttggccgaccgcctgaaggtgacgcccgtggtcgatgcatcggcaaacggcgccatgactgcgttgaccatcggattgcaaaccctggagcatttgatcgggagggcaagtgcccaccgcaccctggaagttctcggattgctaccggcgccccgtgtgttgatcaaggctatcccgacttccatatctgatatcctgcacacggccattccgaccgggctaaccggcgcccttcagaggctgacggcgcaggcgagggcgttgcagtatctgacggcgctgatcgttcacttgggcacggacatcgaagaacagccttccctctcggcctcgcaacgccgtgcacgggaattgcacgccgttcttcagaagacggaaggaaagatcccaacgctgaacgagctagggcaacaattcaacaaatcagcacggacgctgagcaacgacttccagatggaatatggccagtcgatcgcggctttcatttcagacattcggctgcaggaagcccatgcagccatcaccaagagcaatgtgcctttgaaagccattgccgagcgtctggggtatgtccacaccaaccacttcgtccgcgcattctccaagaaatttggttatccaccgggggcacttcggaagagaagctcggcataacctaacaacccacaattctgttttctgggtcttgcttcaatctgcgactacctgacgggtagctgcccagtcgggagttcatcgtctgggagcgtccattttcaccagcgatgccgatcgtgtcccagggagcatgatcttttaagcgcacctaactcctggaggggggcgccccgtgttgatactccccatcgcctcataccaatttatcgcggttagttatccatgacggtcgcgctggcgctgctggcgaaacccggagccctctacgcacgccccaatccgatcgtagcgcttacccaaacggttggccacttcatatcggctgatttatgtgatgcgacgtcacagatatgtctaacttaaatgctcgttaaagtattatcgacaatgggctttcagcgtgccattctgaccatgctatcgctatttgacatcgtaaatctcttggaactggccgtggttttggctgcggccagttccaaatcgttttcctcagaattgaggatcccagggacagggtttggcaccaatgctattcaaggttgtcatctctgtggctgttcatgaccgcaaaaatgctgatgcccggcccttgaaccgacgaccctaaagaacggcgctggactcgacctcaagaacttcgatcaccagaaccaaaaaatcgtttgcttccacagaattaaagccgtgctcccccacaaagttgtggatttcgcccagcttttgatcgattgggagattgacgaacctatcgccatagacatcccgcatgatccgcaagaactccctcacgtcgccgccccattctttcctgcgtcgatccaggtcaaatgcaggctcaatcgccttcgctgtattgaaaatggtcggcccttcttcagtggggtcgacatcggccttcccgagcagatactccaagctatggggtagcacgacaacggtgttcggcggtcgaggctcctgatgttccatctcgttcagcacgtggctgtaatgccgatcgatcatctcgatggatgttcctgtccaacgcgagacaaagcccaaatcttggcgttcatacagcctgtccgtgataaaggtgtgtcgaaacgatcccaatgcataatggcttttgtaacgcacccccctggaaaacttggcggcatccagcagttcaataaatggcttcgctgtgttgcgattcattgttccatctttgtcatggaacacaaaatcgtcctcggtcacctcatatttatcaaagtgggcgtaagccttcttgaggttgtccacgattgacttgaatcctgactgtggcgtcaccgtccgcaggtgttttctgacatcagcctttttcaaatgctcgggccgcagccggacgaggtatgagatttcccccgccttatctaccccagaaatgagatcgcgaaatctaaggcgcgacgcctcaacggtgcgcaagcctgataagtataacaccatcatgcggtagtggttaattaccatggcacggcgctggatggcgtgaaggtgtttacgacatcgcgatgctgataccttttgcaggcgctcgatttcgtcgggagaaaaggccaagcggacactgccagtgccggaaagtcgcttaaaacgaggaatggcctccgcacgcaaatatcccctggacgccgagaactccatgaactggtagaactgttggcgctccttcctgatcgtggcggggcttggggtgaccggggtgaaggggcgaaccagttccttgccattacgttcatatttaatgaacgtcttacctttgtaggcgatggcatagctctcgcgccattcatgatatcgcacgagatcagcggcggtgatggtgtcgatcaacttgtcgtcgaagaatggaacgaaataccgttccaaggtggtgctgacgcgggcacggacgtatggtttgacgaagccaagattgacccgctcatcgagccatcgcagatattccgacaccaacccgttgaagctcttggggtgaaggctctcgcctcgttccgcccgataattcagggccgcgtaaagctgccgggccttgtctttagccctttcaaggtcgctttcgccggtggtgcgttccagccgattgccatcattgttgatggcgaacatccctggagcgggagccatggtgacgcgggcggtccaaatggatcgaccttgtttccggcgcagaattactgggatatctataaaccggaactcgttgagcgattccgttgccagatctgaaacccctgccttacggcccttggagtggttgcctttgcgggtcaatggtttggctgcgttcataagcgtccccggatcgtccccaaaacctgccaccaagctatggtagaaagtatggcataggtctgtcaattccaggaacgatgaaagtcgcagttttcctatatttaaaccatcaaagatatcgatttatagtcgcaatatgatgaagtcaataggagggcaggaaactctccgaaggcagaggtcgtaggttcgaatcctaccggttgcgccaatctccttaccgcaagaacactgggtttcagccgatttcggattggctgacttgaaaatcaattggattttcgggacaacttggggacaccaaccgccgtagctgtccccgaggcgccccatggcaacctgagctactccccggaaatcggacactgacgggagctacgatctgatgtttgctgatccccaacgacgaggagatcagaaatgtcgaagcgcaggaatcatgacgcggcgttcaaggcgcgtgtcgccctggaggcgctgaagggcgaacggacggtatcggaattggcgtcggccaatggcatccatccgaccatgatccatcaatggaagaaggctctgctggatggggccgccgatatcttcgaacgcggggccaagaagagggctgaggtggacgcggatacggtgcggtccccgcatgccaagatcggggagctggctgttgccaacgatttttttctcaaaagctcaagccatggaccggcaagtgaggcgggccatgatctagccccaacacccggcgctgtcgatcggcgcgcaacgccgcctgctgtcgattgcgcgttcgtcgttctactatgagccccagggcgagacggagaagaacctagccctgatgcggctgatcgaccggctgaaacgggccggaacccgcatctccatggacggcaagggaaggtgcatcggcaacatcttgtccgctgtgcgttcacttcgctccgtcgagcggctgtagcgatccctgaaataagaatgcgtctacctgcatgcccgggagaccggatcgcaggcaagggcggagatcggacgctggataaccttctacaaccactaccagtcacctgcagcccatagcgccccccgtggtctacggaaacaccatcaaccaaacggatcagcaggcccggggagtagctcaattgccgcaaagcggcggcagtgaaaaaacatcagaggaggtccaaggcgttaatggaccgcgaattagacgttaacaaaccatgaatttttgcatggctgggccagcctatacctcggtatactcctctctggacacgccagactgtgtgggaagagggggcagccgtgacctacgggacatccgcgaagatccaagccggggccgaggcctatttttcaccgggccagaccctggtggtcatcgatcccagcccacgcatgcgcgatgaactggccaagttgaccgtatcgtcattccgggtcgccgatttccccgacgtggattctgcggtggcgcgggtaaccaaggaacccgcggcgattctgattggcggcgcggtggcaaccaccggccgagttcctcccatcgagcgcctccgcaagcatcagacgttcggccgcaccccggttatccgggtgggtcaacccaagccggccgccggcggtgcctcggttccagaccgggtgcccgacgccgaaatcaccctgccggtcaagtccggcgatctgatccggcggatctgcgaccttgccaacaggacggtcgaagccgactgggacaagctgcccgagggaccgcgcgccgccctcagccagaccctgtcggtgttcaagggcgtcggcgatctggtgggaaggggcaagcccatcgagttcaaatccgtctccgacgcctgctcgccggtgctcgacagcgttcgccagtcggggcacggctatattttcgagggcctgcggaatcacaatgatatctggtacgtgcattcgctacgggtttcgaccctgctggcgctgttcggccacaagatcggcctggacgacgagtcgctgatgaccctggcctcggccggccttgttcatgatttcggcaagaccaactatcccgccggcctcagcggcaagatgggagctctcagccccgaggaaaaggccacggcccatgacgggcacgtcctcggcaccacggactaccttcgccagcacagcgacgcaccgcgcgccgtcatcatggtggccgagcagcatcacgagcgactggacggcaccgggtatcccaaaggcctgaaaaatggagacatcaacgacctggcccgcatggcggccatcgtcgatgtcttcgcggccctgaccgagcgccgatcctatcgtgccgccatggcgccaacacaggccctggaggtcatgcaggagctgatgcgcgaaaagctcgatctgcggctggtgcgcctgttccgaaacatgctgctggaagccgcctagaccattcccggcccaggttccaaaaaatatccggaccagggccaaggacgacgggaatcgactcaaagtgatggtggaggccatttccagcctgcttccatccccccggggcaagcggaatccagagccgacgcatagcgctcattcgcgccgagacgcgagcagtgcttgcttttctgcgccaatgggacgaagactatcagagtcgattatgccatgagcaaaattcagagttgatcggcatcggttacgggtcgcggaacgcgcggcccttctatccctatctcggagaattcttcatgccgaatggcagcgtcaagtggttcaacagcaccaagggctatggctttatcgctccggacaatggtggtcccgacgtgtttgtgcacatctctgccgtcgagcgggcaggcctctctgggctgaatgacggccagaaggtttccttcgaggaagagcgcgacccccgcaagggcaagacctccgcggtcaatctgaaggtcctctaagccttcaaatgacacggccggcattcttgcgaatgccggccgtgtttattttggggacgggcgatccaccctggcgcccccctactgatccccaaagctcatatagcgggtatcgtcctggacgaagccgccggccatcttcatgaaggcttcggccgtcagaatcgcatcgagcagcgccccatgatgttcgaaccggtcggagcggtcgacccacaggcgatcgcacagcacgtccagtgaaccgggcacgcccggaaagaactgccgggacagttcctgggtacagacgaaatccccgtcgccgaagatcatctcgtcaaagccgcaacgcccggccctggcatactcgaaattgagaaactccatctcgttctcggcgctgtgagccaacagcgcgtcctgtccgatgaaggcctcaaaatcgtcgaggacgtcgcggaacgacggcgcagtcttcagctcggccgggctgattccatggacatcgatggacgccttggagatggggccgccgggctggaggcggcgctgccagctttcgccggtcttccacccctcgtcgccacggaccagttccaggcagccgatttcgatgaccacgccgggcaggcgcagccccttgggcatcttcttgatctcggccggggtcgggaccttgaaccccgtggtctcggcatcgatggcgacaatccgcgaagtggtggccaaatcgtcgagggacagcatggcggtcaattcctgaaagaatgcgagggaaacgctcagaaccggtcatcgccgcgctcgaccggtgcggcaggcgtgaagaaccgaaggtccatcagcgccgagacggaaatgatccgcgtctcgccctgatgcaagaagctctccatgcggacatggggaatcccgtcgaccgtctcccagacccgggacaccacccagaccttgttgggctggtcgccgattttgacaaaccgatccccgggctggaccggcggaagggcgcgcttaaaccaagacatgtttgaactccatggcaggagcataccacgcgcagggcgggattcgtcggctaaagcgtgatgccttaacgggccgcaaaaagccccgcttcgcggcagggcacccgccctgacccgttcggaggcccagcctccgaacctccagcttttttattagaaagctgaaggggccgggaagccatgcttcccggttgggggatcgggggcaaaagcccccgaagcggcgcgtccccacagcccgctcaagacgcaaaaacggcctgaaaccaccgggatttcaggccgttcggaagaaagcgccgcccttgcggctcaggctttggccagtctggccggaatggcctgacgaaccgccgttcccgagaccgggtcgacgaaaggcgccctggccttgcgggtgggatcgatcaggccgaggtcgttcagggcgattccggcatcgatgccgggaacggagggctgcacctcatcgccgatccgatgggcccgggcgcccagttcgcggtgcccgaacccgtgttccaccgccagcaccccctggcgcaccccatggcggaccaccgccaccgccgaggccgaaccggtgggcgtgctgatgcggatggcgtcgccagtcttgatccccgcccgcgccgcatcctcgggattgatcgccaccggattatccggatgcaggccgcgcaggcggttggccgcgatggagtagctgttctgcagcgggctcttgtagctgatcagttgcaagggccactcggcctcgggataggtctggcgcaccggcgtcccgtcggcgaagcggggcggcgcccagaccggcacgccggagaaccgctggcccgacagggaatccttggcggtccccaccacctcgttatagacgttgagcggcttggtgaagcgccaggcggcccattccttgtcgtcccaggcctcggcggcgggctggtagcggccgccgcgcgtgaacaggaacgccgtcttgcgcacctcgtcgggcttcagggtctcttccaggtcgggcatgatgcgcgtgaccccggtcagtgtgatgtcgtcgtcgctggcgtcgggaaccggccccttgccggtgaaggcgacattggcggcggcgcgcagataataatcctcggcccggtccagagggtgggcattgccctcggcgtccttgatggcggccgcaccgaagcccggcaggcccatggccttggcggcggcgatcaggaaggcttccatgccccccggctgcccttgcgcggtcttggccatcttgggctcgaccaccggccagcgcgtcaggaaggccttggtcggcacgcccccccaggcggcgacgaagccccagccctcgtacatgaaggcgtcgggcacgatgtagtcggcgaaggacgaggtttcgttgatgaagcaatccatggccaccagcaacggaatcgccttgggatcgcccagcaccttctcggcgatggggcgcaggccgggaatgccgtagaccggattggtcgcccacagcagcagcgccttcaggccatagggatagcccgactgcgccgccgacagccattcggtggccagttgcggcgcggtgccgtaccagggctgctcggcgggatagggcttggcgccgctttccttcttgcgcttgaactcggccgatttctcatagggcgtgttgcggcccagcggcgtgcccgacggcttgatctggccctcgaagccggccagttgatagcgcggcccgtcctcctccttgaagccgccgccgttgatgatggtaccgcccttgcggttgagattgccgatcagggtgttgaggctgaccagggcgaaggcgttgtagaagccgttgccggccatggtgccgccatgggtattgatggcggccttcttgccatggctggtgaattcgcgggccagaccgacgatcacctcgagggggatgccgcaggcgtccgagtactgcgccatgctctggctcccggccgcctgccgcagcagggtcaggctggagcgcaccagcagcttctggcccgacacctcgatctcctggtcgacgaacaggcgggcggggccggtggccttggcgtggaagatgggcttgccctcgccgtccagcaccacgaagggatcggcgtccttgtagcgatcggcctcggggacgggcagccccatgtcggagccgcgcaggaagaagccctggcgcgaatggccgggctgggcgaccacgaggtgggtggcgttgcaccacgccgcctcgccggccgcttcggccaccgcctgattgggctgggccaggaaggcggcgtcaaagcgctcgttctcgatgatccagcggatcatggccagggccagggcgccatcggtgcccggccggatgggaatccagcggctgcgctcttgcgccaccatgttgtcggcatgggtcagcaccggatcgaccaccacgtagttcagcttgccctcggtgcgggcgcgggccagcaaggtgccctggcgcttgaagggattgccggcattggccggggcggtgccgacgaagatgatgaactcggcgttctgcaggtcgggcttggcgtggggcatctgcttggtgtcgccgaacgccgcccccgagcccgagcggtacgagccgccgcaataggagccatgccccaccatgttgatggagccgtaggattgctgcacgaagcggcgcacgaagttctcgcggccgtcattgaccgaggtcagcatggccacctgattgaccttcggccccaattcgggctgggccgggtcgatgggctcgaagctgcgcagctcggccagcccggccaccctgccctcgccgaacaggtcgccgccgaagaccacctccttgaccagttgctcgaaggagatgggctcccaccggccggaattgcgcggccccacccgcttcatgggccgggtgacgcggaagggcgagttcatctgttccagcacggcattgccgcgcccgcaggcggtggagcggcccgcaaggcccttctcctcgaagcgcgacagatgctggaagctcttgcgcaccggcacgcccatgggcaggtgggggtcggccgacagcgggctgtagggattgcccgccacccgcaccaccgtctggctcgccttgtccacccggacccgcacgccgcattgggtggtgcagcccaggcacatggtgtagctgacctgctggtcgggattgagctgcagcttgccgtcggggccgacggtcatctcgggggccagggagcggccgtggatgccgccggtcttcttgtcgcccagccaggtctgggcggcgcgggcgccggtctgggagaagccggcggcaaaggcggccaggccaccggcggcggcgccaagcttgaggagatcgcgacgcgaggacatgattcagactcccttggcggagtgatgccagcggtcgaaacattcgaccgctggacggtcacaaggtggccgcgcgccttatggcgcggaagccaagcggcccggagggcgcgcccggcgattgagggcgctggaaaggtgtcagcctttccagccgttggcatgattgcggctgtccgaccacggcaacagggtggtcagggccagcaggatgaccagccacaggccggcggtgccgatgatgcccatcaggccctcgggtcccagcggcaggtggtattggtagaagccggcgccggtcttgggcacctcctggccgccgatgaacaccgtccagcggaacatccaggcggaatgcagggcaatcaggccggtgatccagccgctgcccgccgggcgcccgagggcaagtcccaggggcaccagggtggcggccaccgcccacagggcggtcagcccccacgaggccgagccggagacctcggccagggcgcgggcatggcggggcgacaggccggtcagccccagggccagccagactccgcccagggccagaacggccagcagcgccttggccaacagcgcgttcagccgcgcctccacgcccatgtcgccctcgcccagggtgcggttgagaaccagcagcaggcccagggctcccaccatggcggtggccaggaactgcagcggcagaaccggcgtgttccacagggggcgcgccttgaccaccatcacctcggcgccggtgtacagcatcaccagggcgccgccgagaaccgccagggcggccccggcccgcagcaggccgggcagggcgccgccgcccagcaggcgacggaggggcgccaaggcgccgccccggcccgcctccgccgcgaaggccggacgcagggcggcataggcataggcgaacagccccgccagatagagggggatgaagaaggccccccaggccatccacgagccccattgcggatggagatagaagttcaggaagcggccgggctggtgcaggtcggccagcagggccaccggcgcgctggcgccgcacaccagggcgcccagcagggcaaggcggccgacggcgccccagtcgcttcgccccagcagcaggccgggcagcgacaacaggaacaggcacaccgacagaccgatcaggaagaagtactggaccgcccagggcagccaggccacatcacggctgacatacaggatttcggtgatggaagacgacatgacggggccctcctaaacgtggctcgacggccgccacagggtgggcgttccgtcgacccggccggcgaagcgctcgtccaggccgatgtaatagacgttgggggcggtgccctgctcgggcttcagaaccttggtccgccccttgttggcgtccagcagccggcgcaccgcgccttcggtctcattgagatcgccgaacacccgggcaccaccgacgcaggtctcgacacaggccggcagcaggcccgccgccacccgatggccgcagaaggtgcatttgtcggcggtattggtctcgtggttgatgaagcgcgcgtcatagggacaggcctggacgcagtaggcgcaaccgacgcagcggtcggaatccaccatcaccgccccgtccttctgctggaaggtggcgcccaccgggcagacgccgacacagggcgggtccgagcagtggttgcacaggcgcggcagcacataggtgccgaccttgtcgccctccgtcacctcgtaggtggagacgaaggtgcggaagctgtccgccggcacccggttttccatgatgcagccgatggtgcaggcctgacagccgatgcacttgccgaggtcgaccaccatggcccagcggcgggccggatcgccgcccggagaggcggccgcctcggcggcggcgggaattgcggccacggcgacggcaccggcggtaatgcggcccatgcccttgagcaggtcgcgtcttgaatgggtcatgcccggaactccgaaaagcggatcggtctcggagatcaggctatagccgttggaattttgcgggtattgggggctcccccaggggaattagggtttaccctaagcccaccatcaattgggccagttcagccacggatcgggccgccatcttttccatcaccgcgtgccggtgaacctccaccgtcttgatggacagatccaggtcgaaggcgatctgcttgttgggcttgcccgccagcacccggtccagcacctcgcgctcgcggcgggtcaggctggccagacgcttttcgaccacgtcgcggttggccgcatcggcgagcttttcccggctggcccggatggcggcggtgacggcgtcgagcagaacctgatcgttgaagggcttctcgatgaagtcatgggcgccggccttcagcgccgataccgccatgggcacgtcaccatggccggtgacgatgaccaggggcagcacgaatttgcgctcggccagcaggcgctgcaattccaggccgctcatgcccggcatgcggacatcgagaatgacgcagcccggccgcccgtcatcgggcaactgggccaggaacgcctcggcggtggcgaaaccccggctgtccagccccaccgaggccagcagaaaggccaccgaaccgcgcatggcgtcgtcatcgtcgaccaccaggaccaggggcttcaaggcatcggtcacgctggggcctccgctggcggaatgacgaagcgcagcgtcaggccacgccggggattggcggaggcccacaggcgtccgccatgggcctcgatgatggtgcggcagatggacaggcccaggcccagcccttccggcttggtggtgaagaacggctcgaacagccgggcttcggcctcctggctgagaccggcgccgcaatcgcgcaccgccaccttgacgccgccctcgcccggggaggtgcgcacggtgatgccgtcgccagcctccgccccctgcccggccgtggcatcgacggcattctgcaagatgttcagcagcacctgctgaatctcgccccggtccaccgagacgccgggcaggccctcggccagatggacatgcacggcgatgccccgccgtccggccagggattcgaacagggccagggtctcggccaccacctcgttgatgtccaggcgctcgcgccggggcttgcgccggcggacgaagccccggatgcgctggatgatggccgccgcccgctcggcctgggtggccaccgcctgggcgccgtcggccagcatggccggatcggcctgcccgccgtccagcatgcgcgacatgccccgggcatagttcatgatcgccgccaggggctggttcagctcgtgggcgatattgctggccatctcccccaggatgcccagccgcgagaactggtcgcgctcggcccggtggcgggcggcgtcgttctcggcccgctcgcgttcggcgatctcgcgttccagctcggcggtgcggcggcgcaccagcacctcgacacgggccacatgcaccacccaccacagcaccgccatggcggcgatgaccagccattgccagtggcggcgggccagttcggccagattcagatgctggcggagatgggcataggggccgatctccaggtcctgcatcagggcgtgcacctgggtgtagtcctggggcgccgtccaggcctggccgtccaccgccggcatggacaacagcgccgccgccacctgcttggccagatcatgggaggtctcggccagcttggcgaacggccagtcgggataaagccgcgacgagacggcgcagggcagcttgggctcgtcccgtcgccccaccacccgaagctcgcccggcgccagggcgccctcggcgatcatctcctccagcaggcaggcccgcagcaccccggcatcgaccaagccgtcccgcaccaactgggccacccgttccatgggaaagccggtctggcggatttcccgcaggtcatcggacggatcgaggcccagggcggccagctcgcgccacagaacctgatagccgccgaacgcctcggtggagaccacggccagccgccgccccttcagcccggcaagggtgtcgagatccggccggtcgccccgcgccaccaccgtcgagccgatggcggcgatgggcgagccgctccgctcggattccaccgtcaccagccgggtggcgccgaaaccgctttccagggcgatgtaattgccgggattggtgatgacgaaatccacctcgcgcccggccaccgcccggctcatggcgtcgagatccagaggcaccagcacgaagcggctgcctcccacgctgcggttaaggtgcgcagccgtaggctcccaggtgcggagcgcgcgctcggccccctggaaggccagcacgccgatccgcacctcggcggcaaaggcgccggagcacgtcagcagacagcagattaggaaaagccggaaaaccatggcaagagactgaccaaacgggcagcaaacggcaaggccaagaaacgccggtctggactgtgcccccaaggggacgcaatatgccgcggcccgccgatggccggcggctggaaatgggtgagcggaaatgaccgacgagaccgacgaagccaaccggcgccttgtcgccctggaaatccgcctgtcccaccatgaaatcatggccgaggaactgtccgaggtggtggcgcagcaagcccggagcatcgacgtgctggtggccgaggttcgccgcctgaaggaacggctgggcgaggccgaagccggcctgcccggctcgccccaggacgaccggccgccgccgcattattgaacgggaaaagaggatgaaccgatgatcggcaatgacggcaagcccgtgacacgggaccagatccgcgcggcgatcgccgtctataacgcgggcgagcgcggctccagggagttcgccgccatcccccgcgccttggtgaccatcctcgacaatctggcggtgggcaagacctcctacgtcaagggcggcgacggccagcttcaggtcagccgccgcaaggacaagaccatcgccgccggctaacggcccctgaccggaaagtcaaacgccagcagacgctcgattccaaaatggaaagcccccgaaaggcgttacctttcaggggcttaaagtggtgcccaggggcggaatcgaaccaccgacactgcgattttcagcagatgccgccgcaagctaatgcattgaaatataacaacttgccccaaacggccgctgatgcaattagcttctattttctctttgttctcaaaaacttgcgagtcacggacactgcgactaagattttggggcaagtttggggcaagttgccccccacctaccatgtccgagcccgcccccatgcccgcttatgaaactgaatggcacgacgaaaccggccaactcatcctcttccagcgcccgtcgtcgcgctccaaggggcggttctactttcgcctccagatcttaggtcagccgcgtaaagagggactggtcgccgccgaattccgatatagccctatgcatctcgcgacggcaggtagggaattcgattttgaaacggtcaagcgaaacggcccgcctgaagagatcatcgaatttggcaagcgcatcctctatcgctatcgcgagcaggttgggaaaggcaaacgcctgaactcgcgccggactccaaccctggccgaggccgccgaggattaccttgacgacttgctggagttgcaaggtcgcgggcaggtcagttggacgaaatatgagcatcaccgcagttttatcacgcggtatgtcgcccgatacgatctgttccagaagaagccaattgatgagatcgatacggtcgatctggctgtttggcaacgctggcgagacacctattgggtcagtggccaaggtgcccaaatcgatgccatagagtcgttgcgtaatggcgagccatttgttcggcggataaccgccaaggaaaaaacgattcctgcgggcacaacaaagagcaaagaatggtcctatctgcgggcggtcttcaaatttgctcgtaggcagcgacatgtgacatcgatccccgaccatgcccccacgaccacggacacgccttcatcagcgtccagtcctactccgcacttcacccagactgactggatgcatttgttggaggttattcccaactggcttaaccctccaaagctggtaggagataatcggcgccatcgccaactttgctggtggtgctgccttaccctccgggcatacggtttacgtgtggccgagggataccaattgaaattttcctccctcctccccgacgtcggccctgatggtgaggaaatttatgtgaagctccacgtcaacgccgtgaagtcactggtcaagccgcgcacggtggaacctatcgatcacatgcggcaggaaatatcgacaatcctgctgaagacgttgcccgcgtattacgaggcccaatttggcagaaagcccactgccaatgaccccttatggatgcacagggatggcagtgcgattggctcattcgccaaaagctttgatagccttttggattccgcaaaactgacgcacaatgtgtacggccatgatttcgacctaacaagcatccgccacacaaccattacggaagaaattgaaacgagcgatctgaaccctggcgtaatcgcgacctgggcaggcaccagcattgccatgctggacaagacatacaaccacgcactgggagtccgagcacgtcggcaggaacgagaacgacgggagcgccttcgccaaatgagttcagaaaagaaatccgataagtagctggactacgcctccatacctaacttttaaatgagtcggcaaaaacactctatcgccaaattggccttccattgtcactccctctcagccctgaacttgccaacccatatcactaactgatatgaacgtaggcatgccacatgctgatcagaccctcacatatctgctggatcttgatggtgaagagatcatctacgatgacggttatgtcgcccgattcaaggccaaggcgatcgaagctacggctgaaaaaccccacggcgtttcgtattcgctgaccttccattcccgcgatggccgccggttgatgggatacgacaatgcccatggcgttgggcatcgtggcggcaagtttgtcgaacgccagaccgccttcgaccattggcaccgcgacgaatccgatgagggtcggccctaccagtttgtgacagccgagaagctgattgccgatttctttgatgagatcgagcgcatcctgaaggagcaacacgatggctgaaaagaccaaggtcggcatcgccacccacaatgagcttcgtgagcgcgccttgcagatcgctcgcggtgaacgtcggcgcctgcctgatgaaccgaagatttggttcacgtcccttgagtcgttggcgaaggtgctttcggagccaaatcgcaggctgttgcggatcattgatgaacaacacccggcatcgctggccgagttggaggtgatgagcggccgtaaggccagcaatctctccagaacccttaaaaccatgagccaatacggcctagtcaggctggtgccaggcaagcgtggctctgttgcccccgaggtgctggtacgcggggttcagatggacttgagcatcgttgggtaatcagcccgttggcttggcccatctcgacgcaggataagtgtggggtgccttctctgcccccgccgtatcagaggaggcctctgccgctgcagccttgggtttccgcccaaggccgatctggatggccatctccgagcgcttttgcgaatagttgggggcggccatgggataatcggcaggcaaagcccatttggatcgatacgcatcgaccgacaggccatgcgatgtcaacagatggcgccttagcatcatttgcttcttcccgcattccaagcaggtgacggcatcgggcgttatcgactttttgatcggcaccgccgggatgggacgatccgcatcaactgagggcggagcatcggtaccggccaaggctgcgtaggtagccttgatgagctcagggagatcggtgatggggatctcgtgatttcgcaaataggcagctgcaatccgagcagcaagagacatcttttgatcaaccactacatttctccctgagatgccaagcaaattaacgcgtcataacgacgttgcgaccgcctgccttatcatatccataagcgtctgagatttttttgcactaactttgtcagagtccgtccgtgaagtttcctatgatttccggtgtcttgctatccttcgcagcatgaggcggatcatggcgaggcgaagaaacgccagcgccatcctggcgagattctcgaagtccttggcgagacggcgacaacgccccagccacccgaaggtgcgctcaacgatccaccgctttggcagaacttcgaaccccttggcggtgtcggagcgtttgacgatttccaggtgccacgccccgagtgcgcggacggctgccgcggtggcggccccctggtagccgccatcagcgaacacccgaacgatgaaggggaagaggcgccggacctccttgaggaccggcaatccgccatcacgatcctggacatcggccggttggacatgagccgcgaggatcaagccaagcgtatcgacgacgatgtgccgcttcttgcctttgaccttcttcccagcgtcgtagcccgatggatcaatccgcgcccccctttttccgcgcccttgacgctctggctgtctatgatcgccgccgtcgggctggcttctttgccggagagttcccgcacctcgatgaacagggcgtgatggaggcgtgccagcgtgccatcccattcccacagcccaagatattcatgcaccgtgcttttgggcggcaggtccgtgggcaatgctcgccactggcaaccggtcatcaacacgtagaagatcccattcaccacttcacgaagatccaccgttcgctggcgcccgccgcgctttgccggtgggatcagcggcgccaccagcgaccattcctcatccgtcagatcacttggatagcgaagtccgctccgctcatagagccgtcggttgtccttggtccacatggcgcccccagcatttctctggagacccatggaatcataaccgattcacctgattcaagaaccttccggacggcctctcatcgtctatcttcctccgaagaggatcggcgacattgatccctgcatctatcaatatttgtactatattatcaatattatgccccatcttagcaaaacatgctaactccgctatgatcaactccgtattttttgtctcaatgtaatctcttacagcccgtcgtaagtctaacgtatgatggcgccgattcacggtcgcccattttttaacttcaccccatattcccagcataaccaatcgcagtccaccgtctgcaacgtcacgcctcgcttgctcctcaacggaataaattgggccacgccggacccttccggcattttgaacacggctgcgcatcttagcgcggtctatgatgccatgcggcttgaatggctctaagtcgctctcggggtattttaggcggaatcgtacagcatcacgtttcgaatcaaacgacaaaagccaaaaatcgcaacatactttgtaataagtaggcgcgacaccaaagcgacctgataaatggcgtaatatttcccatttttcaacgtgcgcaattccgacgtatatttttaactttataattaaattgcaaacaaggtgataattatcgctcccatcctcatacagtgggattgccagaagcactcttccgctagcttgcatattaatcacgtcatgcataaatatgcgaccaatatctttaataaaacacccgcaattctcctgcacacgccccacttcatcatgacttatatttcgcacactcacatagtcattcatttttgccaccctatagatttattatattgtcagaaattgtcttcccaatcgcagccaattcacttctacgccctggattagcggtgatcagacagacatcctcaacggcgcccatccaccgctgaccagtgctcgctcgccggatgacatcgccgcggcgacgggccgaccgaagcaattcggccgcagcatcattgctaagccttataataataacatcaagcccgtcaaagactggcggagacgccaatgaaaatagctctggatcaagcgtcgccattgcgtaattagcagaacacagctttgccatatagtttccaactacatttgtaacacccatgattgtctccttgtgcaattgggcatgacctgacgatatgcccgccccgcacctttttcattaattcatttcatcatgtatacaaaagtagtcgcgcctcctcaccattccattgggcggcacttttcagtatttatcaattcagcgacgccagatatgatgtaaaacagccgcgcctgagattgattactggtggcgcagtccgccatggaaggtcaggtattgctctttgacgttaatcatgctgtcggctatcaacaaatacacagcactacaaagacacatgaatatgagcaattcgtctggtctggaaatcacataaattgttatttgcgagggtatttggtattttgtataaatacaaaagacacggtgggtttgcgaactgttccatgtcgatccgtgatgacggatttgttgagttcgcagcaagtcgaagggttaatgacgttatggtcgcccgaatcgataaagcaaaataaggtggtatgttgtttattctcacctagcctgcgatggcaaatcaataacaaggcgtcgtgattctggacgtttataataaacagaatggtctgcgggagaacttcacctgtgaaaaacagagcttccgatcccccgaatggtttttatcgatctgagggaaaacttaggcaaagtgtacggtgagaaatagtggcctccactgccatagtgtggaaccgggactgagattggcactcagggttatcttttaaagagatagcagatcaaaggcacctaagctatacgcggacttaataggtaaactgggacttgtcagaatccgatattggcaagttgcaagacgtgtttttttgggatcaggttttagattccaataactaaagcatcgtcttaccgggcaagcggaaggggaggctttgcctacagaatgcagctgcatctgggaggtgacaccacaccagaccgcaggtccagatcaccaccacgcccaccatattggattctctgaactcgtagggtgcgtgtgtccgatggcgcggcgaatttgcaccgattgcattgagaaaaacgaagtcaggcaaaatattgttatattcaaaattacatatcgtcattcgcaaaaatatatatttgcgatcccaacccgcaatgttgtttaaatatttttggttttgctgagtttttttcaacaatatccgccacgaacggtcactcatttctccaatcaggattgtccggctagggggggcaaagcctgatgctcgtctttttagtgttgaacatgtaaagcggataatgctgtcgaacggtgatctgaccgttcatgacctgatttcgatgcggtgatgccctattcggtcagatggctaaatgaaaattggtattatccagggcgcttgtattgatgttctccagcgtgccgaccagatgggaattgctggacgtagccgcatccatgttggtggtgtgccataattccacgttggcgccgttctggatggccacgatgcccgcgttgacattgccaaaatcctgggccgaccccgagacggtggccgtgccttcggcatagttggcagccgccagggtgccgctgctgcccagtccgaactcgcggtcggacagcgaaaactgatcaccggcgaaatcggtaatgctctgggtggcggttgcgctggttgaggaatgcagaacgaaggtgtccaccccagaaccgccggtgacggtattggctccgaagccgccatcgaggtattccgcccccgtgccgccaatgatggtgtcggcgaaatcgctgcccaccgcgccgcccatgccggtcagcgtatcggtataggcgccgtgggtggcggtaccgccggccaagtcgatggtgacgcccgtcacctgatcctggtaggaaaccgtcgtggtgccgtgactgccatccatcacgttgttgccgccgccaccggccagcatccattccccggtgcctgccgtcagcgtatcggcggagttgccgcccaaaatctcggaaatgcccgacagaccgacggtggtggagccgccaatcactgcgctggtcccgccatacatgtcggcgacgatggcgccggcagcgtggcggaaatcagccagatcgtgaccgcctccgccgaccaaactggtgttgccggaatgccagaccagaagatcgtctccggtattgccggtcagcgaagagtcggaagctgtgcccacaaccacgtaatcagtgccggccgtcgtggctccaccctgcccgacgattcgatgggtgtcgccggccggatcaatgatggtatcggtggtgacactggcgatggaaagtgtgccgccgccatccagcacagccaccagattcgagccgctcaacgacagatcgcgcaccagtgattccatgtggcgtccggcgatgtcgaaatggatgctttcgttggctcccgcgccgtccagggccagattaccggtgggcagggcggtgatatccagcacatccgagccgccgccacccaggatgctgccggtgctggcgacgccgactatgaaggtgtcgccgaaggtcgagccctggatgatctcgacacccgagagggtgtcagtaccgccggaatgcaccacggtggcggaacccgagccgatggtggcggtgatagccgaaagagccgccccgtaatccaccgtatcgatgccggtggcggcattgatgatgttgctgcccaggccgccagcgatggtgtcgctgccgctgccggtggtgatggtgtcattgccgctgccggtcgtgatatcgagccccgtggaataggccgaggcattggccacgatgctcccggtggcctgcgaaccatccaccacaccggtgccggccgcttcggccacggtccccagtgtgaggttgagtgccgccgagccggtattgatctccagggtcgaaatgcccgaaagcccgctgaaattggcatccacaaccgtgctggccgaggtaatgtgggcgacggcacccgacgaggtcactggcgacgatatgttgacctgaatggtggcctgggctacctggctggtctggtcgtccaccacccccaccacgaaggtgtcggtcaccgacagattggccgccagggtcgccagcggggtgaaggtccacttgccggtgatggcgtcgatgctggccgtcccgtgggtggtggccagggaagattggggattcccgctgccgtcgatgatgtggaagctcaccgtgtcgctggaagcggtggtggcgggcagaccgaggacccatccgctaaccccttgatcggcggtaaccgcctcgctggccgtggctgaaccctgcgacagcttgagcgcgatgttgtccaactggatctcggccgggccggtatagtactggggcaccagttcctgcagatccagcgtataggtccccggtgaaagcgccgccatctgggatgacaggtcgatattgacgttgtgcaccgctcccgcgtctaccgtggtgcctggcaccgtgtaggtatagacggtgggcatcacgtcaccgctgccgtcggtgacgtgcacggtgaacaccctgtcggcggtgggctggccatctctggccacgctgaaggatggcccgccactcaccttgaacgagaaggacagcgaggcatgaaccggggcgccggtcagggtgatgggctgctggagatggaagtagagaggagtctcgtagaggatggcgccattgccgtccaatacaccgccatcaaagccgttgagcgccacatggctgccgttgagcgagcttgcggggtacaccatccagttggtcaggggactgccgccattggccacggtcggactgagcgatgccacccagccggtgaaggtgccggtttcgaagtcgccattgacgatgggattgctggccacttccgccaatagaccgtggctcggcgcagataccgtggtggttgccgaggcggtcaccagacctccccggccatcgacgatggtataggacagcgtggccgggccggaataaccggtggtcggggtgaacaccacagtggtcgccgtttcggtcacggttccatgagtggcgctgaccgaacccaatcggatcgaaagcacatcgtgattcggatcgctggcattggccagcaggtccgatttgagaatcgtggtggcgctgcccgccgtactgccgggaagcgtcaccgccgaactggtgggatcattgttgaccggggccggtggcggcggagccggcggaggaggtggcggagccggcggaggaggaggcggagccggggccggtggcgaaggaggcggtggcggcggaggaggtggaggtggaggtggcggcggcggaggaggaggaggggccacgtcgacaaccgcggcttccgcgccaccacctgccccggctccctgacccgctcccttgcttcctccggcaccggtaccaccggcgggggctggtgcaggagctgcaggcagggcgggagccacggcgggcggcggagcgggttgtggcgcaagggcagccacggcggcggcggcattggccgacaccgaccaagatccggcggatgtagcgccaacgatgcctgagccggcggaattcagagtgaagctctggccgccaccgctcagcgcgctgaccgccacctctcccacgaaattggagccaggatcgggcagcagggccacggtggtagcgcccccctcccccacggaaccggcgacggtggtgccgcggatgcccaggctcatcaccggggtaacgatgcgggccgaatcgggctgggttttggcgatatctccagacacaaaggaaaagccgccctgagccacaaggaagctttccttgccggtcttgcttgcggggtcataggtgaactcatccagcccgaccagccccttgtcctttaaggtgaatgttgtgcggtcggcaaacaccagggaaatctgggcgccctgggcagtctccaccgaatcgccttggacgagggctgccccagtcttggccggaaccttctggccgtcatggatgatccaggcgtcgccgctgagtttgtcgatcttgccgatgaccgccttcgcggatggcttgtccgtgccactgggcactgaatcagccatcaggctggtcaggttgggggccgccggcaggattgacggatcaaggcgcatggttcttacacctgtggccggtcatcacagactcccttccgtggcggaaaggggcgaccgaactggcttgccaatgaatcggcatttcccagatagaccacccatccacctctgaatggcgaaagaataaccatgttttagtccacctggaaggttgaatggcacagtgacagcctccaatgcggaaaatttgtcacttcaacgaccatgttcgacatcagacgcgtaatttttgtccattttccaacgggacagacgtgcttcgcttggtgttcgcctcgaactgttgatccaggctctgcacaacgaggacttctgtcgtctcataccctgccaaagcactcagggctagcgccacgttcgcggctgccggttcagcgtcacggatcgcgccggagccccgcagcccactcgcggctgtctccgggcaatgacggagcaggacgccgttggggggctgattgtttctccgcgctccacgtcatcgtcagcggggcagcggccaatatcctactaaacttgtcaacatctcttgtgggggttcccaagaatgaccatatgctgaggacatcgagaagggggcgtggattatggacaatcccacgaggcggacgttgactaggctggaaaagggcttccatgcggtggtggctgtctgcatcacgacggccctgttcgtcttggagcggctgacagagcccatgaccagcggaggctccgtggaaggccacttcatcttcctggccggaaccatgggtctagtgtcggcatccttgtggatctactctttgtggagccgcagacgtcagaaggtgattcgggaagcctcagcggcccttatccgcaaagacattgatcgtgggcggttggtcatggcgtaccagcccatactggacatggattcgggcgaggtcgtatcgtgcgaggcgttgctgcgcgtcctggataacgaaaacaagcccatggccccggcccgatttctggttgaggttgaggagcatgggctacaggcctatctcagtcgcgccattgtcaggatggtggaggtcgattatcgagagcataggctcagtcttcccgtgacggtcaatctgtccttggccgatataggcgacgacgacctgatcacgctgctgttggtgcctcgctccttcgcattgaacatagaggtgacggaaactgcctttctgggtgcgacgccccatgcccttcaaactttggaccgccttcgcggtcgaggagttaaaatctatctggacgattttgggacgggatattcttccttcacgcatctggcggagatgcccatcgacgtgctgaagatagaccgcgagttcatccgcaaatcccagctttctcccaagcatgccgccatctgcaagaccatcgtggatttgacgcggactatcgatgtggcatcggtcgccgaaggcgttgaaacggtagaggaacagcgcttcctgcgtggcataggctgtgaccgaattcaaggctatctctaccatcgccccatgaccgcatccgcgctggcatcagtcctgtcggatgcaccacggatgcccgtcccacaaagcaagccctgggccgttcacgctccaggcccgtcgctgacggcgcacgctaccgcaatccatcccatgcccacccggaccctcgccgagcacttggccaattgacggcggcctaacagggctggcggccgtgattgcaagggatcacggaccggcctcaggtgtctgtcaggtcggcttccgagcagacccggtcgcgaccgctgctcttgcctatgtagagggcctgatccgcgcggttcagcaattggtcgatatcgtcagatggtccgagggtagcgacacctatgctgacagtctgtcgccgaccagtgtcgaagtcatgatcgcgcaccgcctggcggatacgttcagcaaggatcagggcctgatccaggtgggaatccgggcacagtaccacaagttcctcgccaccccagcgggcaggcaggtcgatggcacgcaccgagcggcgaacgagatccgccatggcgatcaggactttgtctccgaccagatgcccgaattcatcgttgatccgtttgaagtgatcgacgtcgatcatgatcagcgacagcccctgccctaggcggcgggcccgggccaattcgatgggaaactgcaggttcagtcgggtccggttgggcaggttagtcaggttgtcggtctgtgaaagcctgtcgagttcccggctcagcttgcgcatccgccatccccagtaggccaccaccgccaggacggcgctcaggcccagtgcgatcttgatggtcagggcatagtcaatgccggtctggacctgaattgcgacgtgctggttgatgatctggccccgttcggtgggggtgatcgtggcgatggccttgttcaggatatcgcgcagcctcggctggtcgcggaggactccgattcgcagattgtttgagtaattgggcatctggccggcaatcttcagattgaacagcccttccttccggatggtgtaggccgcgacaatcagcgagcgcagagtcatcgatgcctgtctcgtcgagaccatatcgatggccgatttttcactgtcagtgatgattacgcgcagatttggatagtcccgacggatgcgttcttccatcgaggtaccgctaggcagggcgatactttccccgctcaggatcgccggatcaatgatgaaaggatgttcctcgcgggtgatgaagacgttgctgtcggtgaacaggggttcggtgaacaagagccactcgtcccgcttcggagtctggttgagaaaactcagcaaggtgcactgaccggctttggaggtggcgatgctttcatcccaatccgtggtcggcaccaactccaggctcaaccccgcccggccggtcaccagtcgaagtaggtcggcagcgatgccttgatgctgccctgccggtgaaataatctcgaatggctcccagtccggatcaacgcaaaaactcacctttcccagcgaagccgcataggcgcggtcgctatcggtcaactcggcagcccccgccgaccacgctgccgtgcaaagcagcaagaccacaagccaggtgatggtcgagagcgagcgcatgggcgtcagtatccgtatttcaccacgcccagcacccgcgaggcggttccggttccggttgggctggcggtgaatgcctcgtagccatattcgatgccgacatccaagggggcgattgggctgtagacgatattgccatggaccgaagccaggctgcgaatgcccaagccattggtgccgatattccggctggcgttggcaaattggtcatagccgaccgctagggtcgagcgcagcttcggattccaataatgcttgtaggccatggagccaccgaaggcgtcgaatgtccggaatgagttgttgaccacggccgcggaaaggccggtcccttggttgagggctcctcccacaccggttccattcactgtctggagggtcaggatgtcgtcaccgaaggtcttgatactcacgccgccgagaaagccccagacaatctggtcggccttgtcgccagtcccggtgtctgaccgcagatagcggaccatgccgcctagcgcataatgcccccaagattgcccggccgtgtatttgagcacaagatccggagcggtattgatcgccgaaggggcggaatagtcggacgtcggcacttcggcggccatgtccaatttgtcccgatcgccggtctgaatggaatatcgaacctggggacggcgcagccagctgtaaccgaccgatccccccgccgatagcaggtccggcaggctgtccatgtccatgaaagttgaccaggtctgcccggccagccaatcggcattggcgatatacgcatgacgaagcctgaatgtgggcgaggcatctgtccccagatcgaattcaaggaacgatttcatgtcaccgatttcggtgtggctcaacgtcccgaaattaaaccgcgaacccgaaatggatccgttcagagcgccattgcggtttgctttcgcagtgccgcgggccgggatggcggtggcgtcgtccgttcgtcctccctgggtcgattgaacgtcatcccaaacctcggcacggatagctcctccaaacttgacggcggtgctggtcccagggaccgggatgtagcctttcggccaggctggctgctcctgtgcttcgggggacgccggagcggcggtgtttgtaggatgggtggactgggtggctgacgaagtcgcggtggagactgttgtattcggggagcgaggggcaggttggccgcgttctgcctgcagctgtacctggatgcgggatagggattcctgcaacacccgaacctgatcttccaaatcagaaattcggtctgcctttaccggttctgcatgaattccaattgcggttgcaagcatcagtacggagagtttccgcacctgcgccaaagacagaagccgcattttttcaccccatgtccgctaccgcccatagctcaggcagcacttgcgcttgaggaggtgccatactttggtgtggaggcatataaacaaaatgtaacaatcctttcggttgccctcgttgctatacctctacagggcaagagtcatcttgtcggtgacgtctcttgtaccgcacagctcaggagaactaagcatggtgacgaagttggaaaagattctctataccgcgaaggcccacacaaccggcggccgcgatggccggtcggtcagcgatgacggtctgctcaacgtcaagctgagcccccccaaggcgatgggcggcgccggtgacgccaccaatcccgagcaactattcgccgccggatattctgcctgcttcatgggagcgctcaagtttgtcgcaggggttaagaagatcaccgtgcccgccgacgctgccatcgacgccagcgtgtccatcggccccattccacaagggttcggcatctccgcgcagttggtgatcagcctgccgggcatggaccgccaagtcgcccaggaactgttggaggcggctcaccaagtctgcccctattccaacgccactcgcggtaacatcgacgtcgtacttatcctcgcctaatccagagttatgcgggcggtggggccgtgtgcaacacaactcaccgccctgccacacgttcactgatcgggggagctgttgggcaaaaaccaaatgtcttatgtgggtcgattctgttgaaaaactcggccttgcccgttaggcgagcctatgattcaatcgagtagagtaaaactacttgatcatgcattatgatgggcgagcgaacggtgatgcaggaggcgctgttctacagcttcaatctggaacaacatgtccctgccgatcatatgctgcggtcgattgaccgcttcgtcgacctttcgggtttacgggctcatctccagccgttttacagttcgatgggacggccatcgatcgatccagaattgatggtacggatgttgatcgtcggctatttccagggcattcggtcagagcggcggctgtgcgaggaggtccatctcaacctggcgtatcgttggttctgtcggctcggccttgaaggacaggtgcccgaccattcgaccttctcgaagaaccggcacggacgtttccgcgacagcgatctgttgcgtcatctcttcgagcaaagcgtccagcgctgcatggaggagggactggtcggcggcgaggctttcgcggtcgatgccagcttgatcaaggccgacgccagccgacagaagggtgtcgaaggctcacgagggctgccgcccgaagcgaccagccgcgccattgatgaatatctttctgtgctcgacgatgccgctttcggtgccgccagtgaggtgacgccgaagtttgtctcaccggcggacccggctgcgcgctggaccgccgcccatggagggcaagccttctttgcctactccaccaactacctgattgttctcgaccatgcggtcatcgtcgatgtcgaggcctcgacggcggtgcggcaggccgaggtgtcggcggccaagaccatgatcgagcgggccgacgaacggtttgatctctacccggaacgcttggccgccgacacggcctacggctcggcggaaacgctccaatggctggtgcatgaccggggacccgccaccacgcccaccatattggattctctgaactcgtagggtgcgtgtgtccgaaggaggctgacacggcggcaaccagagcaattgccaagacgaaactcggccggccagggggatgtcctggccggccgcctcttttagatatccgcgccaccgtcgcgggcgatcttcatcccaactccgtcacaccgccggtgggtaatcgatgtagccctgcggtcccggcgcgtagaaagtcgccttgtcgggttcggccaggggcaacccctccgccagccgcttgggcagatcggggttggcgatgaaggcggcaccaaagacgatggcatcggcgcggccctgggccagggcggcttcggcggtgtcaccggtaaagccgccgccggccagataggctcccttgaacagggggcgcagcaggccatgataatcggtcggggtgccgaacagcgccacgtgcagataggcgaggttcagggacgagatgcgctcgaccaggtggcggtaggtctcctgcggggtgtcgtccgccacgtcgttgaagttcatctccggcgagatcttgatgccgacgcggccggaacccgccaccgccgccatggcctccagcacctcgaccacaaagcggactcggttggcgatggacccgccatagccatcggtgcggcggttgctcttggacgacaggaactgctccggcaggtaccccgatgccgcatgcagttcaacgccgtcgaagccggcctccagagcgcggcgggtggcgtctcggtattcggcgatcacaccggcgatctctgtggtctccagggcgcgcggcgtgaccatcggcaccatgccctgatcggtgtaggcctgaccctcggcgcggatagccgagggcgccaccggcagcgcgccaccgggcaggaaggcgggaacggcgacccggccggtgtgcatcagctgggcgaagatgcgcccgcccttgtcgtgcaccgccttggtgaccttgctccaggcggccacctgggcgtcggtatgaaggcccggggtgcggacatagcccttgcccatggccgaagggtagatgccctcggagatgatcaggccagccccggcgcgctggccgtaataggtggcggcgatctcgggctgcacgccgtcgtcatcggcccgtgagcgggtcatgggggccatggcgatgcggctcggcagggtaagttcgcccaagcgcaggggctggaagagatctttggtcatgatgggggctccgtattcgtgatctgcgattgatttctgacctagacgatgccggcacccagggccgggaagacatcggtgaacaacagggtgatcaactgctgcccggcgggcgtggaccagtcctgcgcgatttccgccataagcgtattggtggcggtcaggacgacccccgcatcacgcatccgctggcgggaaaactcttccgaaagatcgctgggcgagcccgaagcatccatcacggcctgcacggcaaaaccttcgagcgcggcatcaatagccgggaagatcaggcaaacatcggtggtgacgcccgccatgatcaggttcttgcgcccggtggccagcaccgcattgtggaagtcggcataggcccatgcgttgaccacgccgggacgcttgacccgtgccgcatgcgcttccggcaggatttcggcgattccggggagaatggggccttgggcgtgatcttcctggctggaggtgatcaccaccggcatgttcaggattttcgccatcttggccagggcgatcgactgcttggcggcaagatcgcggtcgatattcttgatcagctgcatggtgccgacctgatggtcgatcagcagaagtgcggcattttcagcagaaaagcgtttcgtcatgatgtgtttcctttgtgtggataacatgtggcaggggtcaggcgggcaagctgagcgaggcgacacggcgacgcgcctcgtcgagtgcctccggactggcaagcatgagaggaccttgggcataaatcggctgcttgagttgcgcccccgaaaccaccgcaatgcgggcttgaccagcccctgtggcgatccggaacggcccttcgacgtcggtggcaaagccaatagcctgcgtggcggcaagggtcacgtcaccgatcgaaacgtctccctcgagcacaacgacaatgcccccccaacccgcaggtatgtcgatgtcacgcatcgccgatggggccagcgagatttcctcgatccggaccggtgacggcagggctccggcgatttcacccaccgtcgttccatcgaccgcgacacggctttcccagcctttgccggaaaggcttttgaccatggcggccgggaccgaaaaggctgcggcgggatcggcctggctggccgccggcaggttgatgaaaatctgcagcccatgcacgagacctgcttcgggaaccgggaattcttcatgcatcaacccgcgtgacgctcggctccaatgcaggccaccagggtgaatggtctgtacatcgcccagactgtcgcgattgatgaacccattgggcgaatcggcgaacagataggtgacggcggagaaacccgcatgggggtgaggcggaaaggttggggcattcatttcgaaccagtcaatgttgatgaccggatcgataaggttgccaaacgcctggcgaggatactggcgggccgcaaattccgcgccatggcgcatctgcgtcggggtgtagacagacgtaaaacggatcatggcatagtcctctgactgtgttgatatccatatgcgccttaatcactgtccacataaggcttgaagtttggacagcactgttccattttcagaacaatgaagccatcgctcgacgatcttgcgctgctcgtgaccattgccgacgaaggcagcttcacagctgcggccaagacactcggcctgccaaaatccaccgtaagccgaagacttgccgatcttgaactgctcttgcgcacgtcgctgttccagcgttcaacgcgagccctatcgctgacggatgaggggcagcgcatctatgacatggcaaagccgtcgatcaccgccgccgacgatgccgcacgggcaatcgccgagcgcgaacagcttgtcgcgggccgagtctcgctgaccaccacggcggcgcttgggcagtatctgattaccccgcatctgatcaagctgacggcagcatatccggatgttcaggtcgaactgaggctgactgaacggcgcgtcaacatcatcagcgacggcatcgaccttgcagtacggacgggcacacttgatgacagtgatctggtcgctcgccgtctttgcaaggtcaagcgcctgcttgtggcatcccccgcctacctggcaaaggccggggtaccggtggccccctcggaccttgcctcgcacaacgcgatcgtcatcagcgcggccctcgatagttggcgctttgatgggggatgggagtgctcgatgagatggaccattgctgccggcaatatgctggtcgcccatcaacttgcacgccttcaccatgggatcgcgcttctgcccgacttcatgcttgaaacggacctggacctgggcaccttgatccacctgctgccggaatatccaatggaacaggcggatgcctggattgtcagcagccctcaacgctacaggtcgctcgcggttcaaaccgtcttgaactatctggcgggagctaagagtggagtctcggtaggccgccactgacctgttttcatgattgatcccgatcagtggaaggggggcaggtcatcgctgagtccaagcagattcgagcgccgcttatcccttcgaccgagatcggtcggactggaaacggccctttggttaggaggcaacgcctcaggatgcgacgaccacgaatcgccaccccagatgacccgcctcggtataactgacgtggtggcggagctcttacttagttggatgctccgcaaaccccagcaattccgccatttccgcggaactccatggctactaagtaaactaagtaggtagattcaagagctccgcataaaacagaaaataatattttttatttctataaattgtttttctcttacttagtttacttagttactaaattagaaattatcattataattcaacagcttgcacttagtaatcactaagtaaatggattgggcgtttacttagtagagccgtaaccggctccctgggcaccagcctaatccgcgagcacagccaccaccacatcagcccgcaggtcgaagatccaggccaccaccacgcccacctggcaggtggcgatacaaagtggcagtcgaaacattgaggcgccgggccacctcctcaacagtaatcgccggggatgcaagcatggctcgcgccacctccacatcctgaccagacagggaccgaggccgaccgccgacccggcccattttgcgggccgaatccagtccggctcgagtccgctcgatgatcaaacttctctcgaactccccgagcgccgcaaaaacgtggaagatcaatttccccccggcggtggtggtgtcgatcgcttcggtcaacgaccgtaaaccgatcccacgcccgtcgagcatatcgacagtctcgatcaactgccgggtcgatcgagccaaccgatccagcttccacaccaccaccgtgtcgccgttgcgagcgaagtccaaggcggccttcaactcggggcgatcggcgcgggcgccggaggcatgttcactgaaaatgcgttcacacccggccgcatgcagggcgtcgagttgcagttgcggcgactggtcctgggtcgaaactctggcgtaaccgacaaacatccccccctccttctcaatactcattcaattaccgacgaattgagatgcatgttttgagagacagttttgagataataccacctccgctaatcacgcaaaagaccacgacacaaataaattctcataaacgaacgtttttgagagtcatatgtttatacgtattagtcagaaatgcgaacagataaatacctgcacacgcagctgaggaggaatgtgatgcgggatctacgaagcctttataacgaatgccgcgaccttggggccgtcagcgaccagaggtcgttcagccggatgtttgggcggcaggcgtcatggtgcagttcgacattggccagaggacggcggcccaccacgggagccctggtcgcgtttgtcctacagctggaaaaaatcatcgtggccaccgaggaagaaatggcggcgaccataaaccaggaagaagtcgatgctctccgaggtgggctggacgaaatcaccaggatcaaggccgaggtgtggagtgaggtggaaatacgatcgcaacttaatttattcggttaatattgatttattatttcgtagtcattgactctcacatatgtatcgtcacttataatacaatatagattagatgaggtggaagccatggctccagccattattgcgctgtctcttattttggcaacttcggcctatggccagtcctatcgacgccgtcttcgcggcgataggcctccaattcagcccgatcactggcgtccatggcggagcccattggcgtcggccgcttcgcagataggctatcgacttcgctccgcaacccagcgatttcggccttttgcttggccatctcggcctgctgcttggcgatctgacgatccttggctgctgccgccgccttgaggtctttgacctcaactcggaggcaggcgatctcctcgagatacgcctctatatccgcgagataaccgtcgatttcctggttcttcttatcgaccatgtaggcgacaaaatcgtcttcgtcgctatagacgttcaggtggacgtcatccggatgcacattgttttgctggaaataatcaaccaacttgcgaccagccgcggcctgctcgccttcaataggggaaaacatcatcgcaaagatcttttctgcccgcccttttttcgcacctttagccatagccgtattccgatccagtttttaaagcctgcatcggcgataccgctggcaccccaaaaccgtcaattttccaaaatcacagtatttgctgcaatgacactcggccatagaagataagcagatgagcataagcatgattatgcgtggtttatgaggtccataaggcgataatgccataatgcatatctcaattccaggccgcggccggagagtaatatacatgactgcggaggataatacgtgatatttggcacatacatctctgagcagcatcggcaaaaacttggaatattccgcttaggcctgccagccgggctggcgatatgccagctaccgctcgacaaccctgattccgacgggaagttgcgaatcggccagcttctgctccgtttggtcgatcagtcgttcgacccgcgccaggcactgtcgcatcgcgtcaaatgccttgttgacgtcgtacatcagagttgggtgctgatcattggcattgccaacatctatatcatcagaaggaaggatgaagtcatcataagatccatcaaagtcattgagtctcattgcgtcacatgtttttatgttttatataaatatttatcatgagagcaaaagatttacatcaacacacatatggagcgttcgtcatctatttccacgcctccggatgcgtcaaaaagatcgacggtccggacacggatccaatcattaccgtcgccggaaagaagattgaggacgcagtgtttcagttgaccggcgacggtgacgggaagttccagggagtaaagttccgcggaagcgcggttatctatctgccgattcgcgatggcttcggcccagtctgcgcgaaattcgtcaattccgattttatcgtccaggcaggtcatttgtacggccgcctgcatcagaaaaacgtcgagattaaacgggtggtgatggtggatccgagcaccggtcggacggccatacgggatttcacggttccaacttcaacagcctattgacgggccaattgaaatttgtatccagtctggtcacccgttccacttatgtcttccgatctttctcactggctgcatcacctgtcgcagccccccgaagatccaacatcaatcaatgactagcacggcaaagttagatcgttgagccagatattcagcgagttttcggtcttccatcttgatgtgtccggtaacccagtttctcaaggattgaacctcgctcccagataacttcgaatggccctctcgtctcacacgtgcgattagttcagaaagtacccggatcagccccctgtgaaccgccgcatgttcctccctgtcagggtagtcggtttgcttcatcacatcttcttcgcgctcgaaatggacacgggtgaagtccgccaactcggacagtaccgcgttgataccttcatccgttgatggccccgccaaccggatcaccaagaagtccatcatggacgcaatctgggcatgatcctggtcgatgaagtccaccccgagtttcttgccgtcaaaccattccggtgccgtctgttccatagttggacctttgtttgaatgggtgttaacggggaaaatcattggcggcgacaggccgaccaaggaggtagccctgggcctcgtcgcaaccaagatgcctgatcaggtccatctgctgctcggtttcgatcccttcggccactaccttcaaccccatgcggcgtcccaattggacggaactttcgacgatggccagcgatccttcctcttccagcgccttggcgatgaaggactgatcgatcttcaattcggtaaacggtccgtgttgaagttgcttcaatgacgaatagccggtgccaaaatcgtcgatagacagggcgaatcgccgcatccgcaaccgggtcaggatatccaatgatgcggaaaaatcggaagccagggctgattcggtaatttcaaggacaatctgttccggcgaaagcccccgaccttcgacccgacgaagcaggtcttccggtagatcgaggtgccggagggagagggccgagagattgagcgccagtttcaagggccgcccctgatccagccagatacgtccctgaaccagggattgatcgatgatctgatcggtcaggcgctcgatcagcccttccttctcggccaaggggatgaagtaatccgggccgaccaggccgtggtctggatgtctccagcgagccaggacctcgacgccggtgatggcgcgggtggaaacgctgagctttggctgatagaagggaatgatgtgacccgctgccaaggcggcatcgagatcggacgcagtcggaacatactggctgcccggccttgccgaggtagtggggcactggggggcggtgatggcagccaattgatcgtacagccccaccagagccgataattcgaacggcttgtgcagcactccggccaccttcaggccgcggctttccgccaatcgtctcgcggcctccagcagatggatatcgtggccgctcatcaaaaccagatgggccttggaattattgtcgcccaggaagcgaatgatttcgatgccatccacccccggcatggcgaggtcaagaaaaatcccccggaggtcaatggaatagcggcaggcgaaatcttcgaaattgtcgcaccactgcgcattgaaaccctgatcgtccccgacatcggcgacgaattcgcacatatcacgctcgtcatcaagaatcagcacgcgcggctgatctgcttttgccaaatcagtcatcatgaaccatccgatccatcaagaatggttcttaccatccttgccaaatccgccttgctgtagggcttggatatcacagaaaagccgccgtcgttctggtgctggtgggcatatccggtgaagcccgaggtcagcagtaccttgcgtccaaggtctgtcgccagtttggcgagaccaaagccatccaagccccccggcatcaccacgtccgagaaaatcaggtcgatatcggatcgctccttcagcagcctgacggcttcagaggtatcggtggtgatgatcggggcgtaccctaggtcgctcagaaattctccggcgatctcggccaagtgaagttcatcgtcgatcaccagcacggtttccgtgccacgaggtatgtcggatgtctcggttccaatctgaccgggatcggcaacatgggcatggctacgggggaagtacaggcggaaggccgttcccaccccaagttccgaatagacccgcacatggccgcctgagcgtcgggcaaagccgtaaaccatactcagtccaaggccggtgcctttgcccctttccttggtggtgaagaacggctcgaaaatcttatcgacgatatctttgctgatcccggtgccgctgtcgctcaccatcaggacaatgtattcaccgggttggaggttggggtcgaaccgcgcatgttctgcctcaaccacgatgttggatgtctcaatggcaagggtgccgccatcgggcatggcatcacgggcatttatggcgagattgagcaaggcgtcttcgaattcgcttcggttcacgaccgttttccatagcgcgggatcgagcttggtcttgacctgcacgatttgggtcaaggagcgttgcagcatgtcgagcatgccggtaaccgcatcattgatgtcgattgggtcattgccgactacggttggggcctgccgtgaaaaggccaacaaacggcgcgtgagatcggctccccggcgagcgcttttcaacgcggtatcaaggcgtcggtttgctttttcgtcattcgccaaattcttctgaagcagttcgagatttccggtgatgatgcccagcagattgttgaagtcgtgggcgatccccccagtcagttgcccaaccgcttcgagcttttgcgaccggcgcaaggcttcttcggtgcgcttctgtccggtcagatcgcggatgaatccggtaaacagtccgtgcgtaggcagttgggtgatcgctagttccaggggaatttcatgtccatcggcatgaaggccatgcatttcaaggcgctgaccgataaccttggtgaccccgccatcaatcactcgggctattccagcccgatgagccgcacggtgctgctccgggatgatcaggtcggcgatttccttgccaacgacatcttgttcaagatgtccgaaaatgcgctcggcggctggattgaattcgataatcgctccattaccgtcaatggttacaatggcatccagggctgcatccagaatcgagcttttgacctcctcgctgacctgatgggcatcgagttcttcccgcagctttcgcgccagcgggcggaacacgcctgcccatgagaatgccagaacaaatgtaaatatcagcaggccgatgaaggcgctgtaaagaagccggttagcccgctcctggctctcgaattggtagcgagacaccacgctctccaatccttgaagaagctcaacgcgtgacatcatggcaatatcatacaggacaatcagcgggagacgccgatcatcgccacttagttccagatccatgaaatagcgggccctctttataaaatacgagatgcttttatccagtgtcggcgctcggccgaaatagagtgcattcagctcgttcgacatcccgcgaccaacagatatttcaataagcctttgatgctcagcctccatactggcgactgcattctccatattgcttctgactgactgtttcgcctcgtcggatggggatgtgataatttggtatccgaggctgacaacgcgctgagacagcattctctgcctcccagccatattaataatggcaccgtcatcagataagaatgaaacagcaaattctaacgcaccaaacccagatgatgccagaataaatagagagacgaggacgattgcctgcctttttgtcaggcttgcaattaatttgtttgctgatatacgcgcaccttgcattgctataattctatgatagttgctgttgagcgatctatgtgtgtgtggattttcattgaaatgcctcatcccgagcaggccagaatagtctggcatgattttcacgccaaaaaagagcagagcctccctaggccgctctgatttcacccaagaatccgttgatggttaatctcagccgggcggcctcctcgcccatgatacgcgacgcgtcaagtacctcggcggcagcaaaaccggttcgattggcggcgtcctgtactccgccgacattggcagaaacctcggtggttcctgctgcagcctgctcgacgctgcgagcgatctcctgggttgctgcgctctgctcctcgacagcgctggcaatcccggcggtaatctcgcctacttcgcggatgatggcgacgatatctcctatggccagaactaccttctcggtctgctgctgtacggcagaaatctgctggcctatctcgtcggtggcccgtgccgtctgagtggcaaggttcttgacctcacccgccaccacggcaaagcccttgccggcttcgcccgctcgggcggcttcgatggtggcattgagtgccagcaggttggtctgggcggcaatgtcattaatcagaatcacaacttcgccgatctttttgaccatactggccaggccggtgaccgtgccctgggcctcaccggcctcagaaactgcggcgccagagatttcggccgaccgatgaacctgccgacctatctcctggattgaagaggtcaattcctcggcagcggcggcgacagtctgaacgttggctgatgccagttcagtggctccagcgacagtagttgcccggccgctagtgtctgaagccgcatcgctcatggcagatgcagtaccctgcagttgttgggcggccgaagagactgcctcaaccatacgctcagccgagccttggaagcggttaaccaaagcctctattgcatggccacgggcctcgcgggaatgagcgtcggccaattgctgctcggccaagtcgtgaccgcgcagcatagcgtccttgaatatctgtactgagcgagccatagctcccatttcgtcaccccgttcggttccgcccacaatcaccgaaaaatcgttggctgacagtcgctccatggtacccaccagtgagccgatggccgatgtcatctggcgcaccacagcccatgccacagccagcgccacagccgccgccgcgagcacaccgaaaatggttgctcccagtacgccgcgggcgtctgagctaacttgcgaggccagggcaagaacatcggcggccatacggtcttcgaccgttttaaggaggttgatccgttcggtagcggcagcaaaccaagcggggcctgtgacatctcccacattgccggtggccgtgctctccaggccgatcttgcgcatacgatccaccgtctgagtagcagggctgtccagggtcgaacgataaaattccacctgctcaggcgcagcactggcctggaattcggtaaggaactgcctctgctcagccacgatggatacaaagcgcaggtagacgtcgggcccaaactttcccgcagcaaaggcgccagcagcggttgctcgctcctgcccggccttctccttgccttccatcagcttaaggtaggcaccaaccatgcgtcctacccagatgtcactcgacaagagagatatctggctgactacgtccaattgcaaccgaatagtctcggtgaagttgccgaacgaggttcgggcgtcaatggaaagcgcatcgatggcatcgcgggaagtgaccagagcttcatagcgcttggcggcagcctcaaccttgggaggaaaactgcgtccaagcgccgtcaggtcgatgctggacaccgagcgttcgagcttggcacgggcctcatcggtcaacttgcgctgtgcctttagctcgtcgcgaaatttttcgcccttgctcccgatgaacaccgccgaggtaccgcgctccttctgcacttcgtgcactagggcgctgatgtctgcggtgagcggtgcaatggccgctagggctgctgtctcagataccacccgcgccttgtcactgataacataggcggccaagccaaaaattagtgcggcgggaaacaggaacgacagggtgatctttccagaaatcttgagatcagtaagccggatcatgtaatccccctgttattattttaggcattaggcattatcatcattattggcgcctatttgcttaccgtagttcgcgggataccatttcaatggcacagaggtgcctggcgcgtcgctctatccaaaaagataggggcaacaaatgatccgcgttaccactactacgccacggaaagccgccactgaattggtcgccaagtgaatttcaggcaaagcaccctttgttccacccactcaaaagtggtaggcgacatataccttatggtaattttttgcatttttcaaatggatgagttaggaaatttcattacgctgtaattcgtcacatttaaaacggctcaagccaaaccgtcaaaatgtgggggtaatcccccctggaaatgaggggatcggaacgtagaattttctcggtcagcggaacgaggagattcggatgaagaagagccgtttcacggatgcccagatcatggcgatcctgcgccaggcggaggacggcatcccggtgctcaacctgtgccgcgagcaccagatgagtagcgcgaccttttacaaatggcgggccaagtacgggggcatggacgcatccatgatctcggagatgaagggccttgaggacgagaaccggcggctaaagaagatgttcgccgagctcagcctgcagaacgagttgttgcgcgaggcccttggaaaaaaatagctcggccatcccagcgccgggagatggccgagactgcggtggcgcgacggggcatcagcattgccttggcctgccggacctttgggctgagcgagacgtgctatcgctacagcccgaagctgcgtcccgagaacgaggagatcgccgaccttctggtcggtctgaccacggcccgcaagacctggggcttcggtctgtgtttcctgtacctgcgcaacgtccggggccatgactggaaccacaagcgggtctaccggatcgtaaccgtcctctgacggctgccttgtgcggcggggcgagttgaggccaagtgccaagcattatggtgactttaatgcgtggcacgatgacccaggtcgaggtgatcacgtcggttcagcgccgtcggcgttggagtgcggcggacaagcagcagatggtggcggagtcggcgatgccgggccggacagtgtccagcgtggcccggcgccatgggatcgcgccacagcagttgttcacttggcggcgggagttgctggcggccgctactgggatcgctgatggtggttttctggcgatcgcggtttcggagcccccggctgtggtgccggacgatagcgggcggattgaaatcgtgctgcccactggcgtgatggtccgggtggggccggaggtggcgaccgagccgttacgccgggtactggcggcgctgggatgatcgtgccgccgacgtcgacgcgggtgtggttggcttccgggcacaccgacatgcgcaaaggttttgacgggctggcgatgctggtgcaggcgaagctgtctcgcgatcccttcggcggccaggtcttcgtgttccgggggcggcggggcgatctgatcaaggtgttgtggtgggacggccaaggtctttgcctattttccaagcgtctggagaagggccgcttcgtctggccgtcgccggcggacggcatcgtcgggctgactccggcgcaactcggcatgctgctggaggggatcgactggaggatgccgatccgcacctggaagccgcaatcggcggggtgagtcattcccgccacacccggcgggaatcctcacaaaatgaggggctggcgctggtcggaatctgcttctgacggtagaatcgacggcatggttccagacgccctgcccaccgatatcgtcgcgctacaggccatcatcgccacccaggcggatgcgttggccgccgcccaggccggcctgatgagcaagacgctggaggtggagaagctgcggatcgagctggcccgtttgcgccggatgcagttcggccgctcgtcggagaaaatcagccgcgccgccgatcagttggagctgatgctggaggaggtcgaatcgagtgccgccgccgccttggcgccagccgaggacggtgcgagcgacggccccgcgccgaagcgcaatcgtgcccggcggccgctgccgccacacctgccgcgcaccgaggtggtccacgatagcgcctgtacctgcccttcctgcggcggagcgatgcgcaaggtcggcgaagacgtcaccgagatcctcgattacgtccccggccgctttcaggtgatccgccacatccggcccgcctattcctgccgagcctgcgagggcatggtccaggcgccgatgccctcgatgccgatcgagcgcggtctgccctccgccgccttgctggcccatgtgctggtgtctaaatactgcgatcacctgccgctctaccgccaatcggggatctatgcccgcgatggcgtcgatctcgaccgtggactcctggccgagtgggtcggcaaggccgccaccctggtccgtcccctggtggacgcggccgaggcccatgccatggccggcggccagatccatggtgacgacacgccggtgcccgtgctggcgccggggatcggcaagaccaaaaccggccgattatgggcgtatctgcgcgacgagcggccctgggatggaccggctccacccgccgtggcctaccgctacagtccagaccgcaagggcgagcgtccacagaagcatctcgccggtttccgtggccacctccatgccgatggctatgccggcttcggcgagttgtacctggccaaggagggcaaaccaccgccagtgacggaggtcgcctgctgggcgcatgtacgccgcaaattccacgatgtccatgtcgccaccacggcaccgatcgccgcggaggcgctggaacgtatcggtcgcctgttcgccgtcgagcgcgccattgtcggcatcccacccgaccagcgtcgcgccatccgacaggtcgaggcctgtcccatcatgggagatctggcaggctacctcgacgccagcctgacccgcatctccggcaaaagcgagttggccgccgccatccgctatgcccgctcgcgctggtcagcgctcacccgctatctcgacgatggccacctggagatcagcaacaacgccgccgaacgggcgatgcgcccgctggcactgggccgaaaaaactggttgttcgccggctccgatgccggcggcgaccgcgccgccgccatctacactctgaccgagaccgccaagctcaacggcctcgacccggaggcctatctgcgcgatgttctgacgcggattgccgaccacccggtaaaccgcatcgccgacctgctgccctggaacatcgcaccatgaccgagattgcccgcctcaagatccaactcgatgacatggacctgcccgtgatccggcggatcgaagtgccactcaccatgcgtctggcggatctgcaccttgtcatccagatcgccatgggctgggaaaactatcacctctacgaattccgcgtcggccgcgccgtcgcctatggcattcccgacccggattggccggactcaaacaccctctccgccaaaacggcgaccctggccgatctcctcctccacctcaaacggaacaaaacattccaatacgtttacgatttcggcgacgattggatgcatacggtgaaactcgaagctctcgccgaagccgatcccgaggtcagctatccccgcttgctggacgcccaaggcgcctgcccgccagaagactgcggcgggccctggggctacgcccattacctcgaagtcatcgccgatcccgaccatgaagaccatgacaacatgatcgaatggcgcggccccggatttgatccatcgaccatcgacgaagccgctatccgcaaggaattcaccaagtttgccaatcggcgtaagcggaaacccaaggcaacgccgtagccgtcagaggacggttacaccggatctatcgggagttggagttgaacctgcgcatcaggccacgcaagcggctcaagcgcgataagcccgatgaactggcggtccccgatgctcccaaccaggtctggtccatggacttcatggccgaccggctggaggatgggcgggctttcaggctgcttaacgtgcttgatgatttcaatcgcgaagggctcggcatcgaggtggatttctcgttgcccgccgaacgggttgtgcggacgctgaatcggatcatcgaatggcgtggcccgcccaaggccatccgggtcgacaacggccccgaatacatcagcggcacgctggcgacatgggccgggaagcgtggcattgctctccaacatatccaacccggcaagccccagcagaacgcctatgtcgagcgctacaaccgcacggtccggcatgaatggctgggccagttccttttcgaaactatccaggaggtgcaggactacgccacggattggctatggacctacaacaacgacagacccaatatggccatcggcggcatcacacccgcccagaagctgaaattggccgcgtgagttctatgttccaaccccgttaaaaacggggggattacctgggtaattggaagcgtcaccggaggggtacgaagaatctcagagcaagggccgctcaaatagatggccgttacgagggggatacgcttattctgaactcggcttaaatcccgccgttaataggttgttccgataggtcagatgccgatcaaacaactcactgatttcatgaaaaaattcgttcgatgcactcgcggttaaggtcgcatctaaactgtccaattgatcaacataaacccagaaccgttgccaatgcgagtggtcatgttgaccatcaaaaaatctcattacatgcttacagctgcactctaaattaaccatcaacttctctcgaatagcacgacctcccatggcagagccttcaataacataccgcatcccaatataatcatttagtgttaatggggcctttcggtcccattgggggacacttggcgtaacaagatcactaactcttccaagttcttcaatatctgacatcaaaagatcactgcgacgcgggacatcagtttccggcacaaactccaagagcgcccgttcagttggggcgtgtaacgtataaagagcaactaaaatatctccatatacacgacacgtaagcccttcttgaatcagatgccgcatcaatggatgatggtctatccggcgatgagctgcttttgtagaacttcgcaaatgatcacgaaggccataacgatcatcaatcctttcaaagagcttactcaagacacaccaacaccatttaatcctaacgccttcatcacgccagaatgtagttgttttattgaaaaaggcttctccagataaacgctgacaccggcattataagcagatgcctctgattctttgcccttattcccggtaagaaggactattgggaccgcaggatcaatgccatttacccccccgcgaatccggcgcgtacactccagcccatccatgacttccatcatccaatccataatgatcagatcagtgtgttcggcttgtaacgcatcaagggcctcggctccattcgatgccagaggcggccccggaaaatcggacagggtgataagctaatcccgaccgacagaaggacggggttttatgggcaaggtaaccaggaagcggtattcggccgaatttaagtcgaaggtggcccttgaggcgatcaagggcgagcagaccttggcggaactggccgcgaaatacgagattcaccacacgatgatcgcgcagtggaaacggcaggcgatcgaggggatgtcggcgacgttttcgggcaagtcggaagcgacgactacgggcgatccggcagagatcgagcggctccacgcgaagatcggccaattgctggtggagcgggattttttacgggatgcctctgttcgcttgggcttgatcagaggcgggaaatgatcgagccgcgtcgcccgcgcctatcgatcgtgcgtcaatgcgcgttgctgtcgctgaaccggtcgggggtctattatcgaccggcgccggagagcccgctgaatctgatgctgatgcgtctgatcgacgagcaattcctggagacgccctattacggcgcccgccagatggcacgacatctgcggcgtcagggccatgccgtgggacgcaagcggatcggccggctgatggagaagatgggcttgtcgccgatctaccagaaacccaagaccagcgagccgcatccgcagcatcggacctatcgctatctgctgaaggggctggtgatcgaccggcccaatcaggtctggtgctcggacatcacctacatcccgatgcgcaagggcttcctgtatcgtaagcatccggtgagcaccgcaggtgaagacggttttgctcaggcggcctgactgtcggcgacgcgcggcagcgagcgccagttccacggcaggagttcatcgatccggttcgcggagtgcccggcgatgcgggcaaggacgtcggccagccaggcttgcggatcgatgtcgttcatcttggcggtgacgatcatgctgtacatggcggcggcgcgctggccaccacgatcagagccggcgaacagccacgactttcggcccaaggcgatgccacgcagggcacgttcggcggcattgttcgacaggcagatgcggccgtcgtcgaggaagcgggtgaaggcgggccagcgtttcagcatataatccatggccttggcgagatcgttgccgcgcgacagtttggcgcgctgttcgcgcatccagatttccagatcagcgaccaggggagcggattgctccaggcggattgcgcggcgctgttcggccgtctggccattgatagcgcgttcgatttcgaacagggcgtcgatccgttggaccgcctccagggccagcggcgagaccggcgccgtggtcttgccgcgtgccttgcgccgcgcgttctcggcgagatcggccatgatgaaaaacggacgccgtgcatggacccagcaggccgcctccaggatcggacccggcttgcggtcgggcgcgtagaccttggcgtagccgccataggcgtcggcctggaacagcccggcatagctggccagatgtccttgcggatgctcgccgccccggtcgcgcgagtaatagaacatcgccgctggcggcgcaggcccaccgaagggccggtcgtcgcggacatagacccaacatcggccggtgtcggtcttgcccttggccaggaccggcacggtggtgtcgtcgccgtgcagccgcccggcggcgaagacatgggcctcgatgcggcggatcagcggctccagcacggcgcagccggccccgacctgatcggccagggtggacaggctgagcggcacgccttccttggcatagcgctcggcctggcggttgagcggctgatgctggccgaacttctcgaacagaatcatcgccagcagtgaaggcccggcccagccgcgaggggtgacatggaacggagccggggcttggctgatcttctcgcagtcccggcaggtgaacttctcgcggacgcgctggatcaccttccactgccgggggatcacctccagcgtctcggtgacgtcctcgcccagcttgcgcagccggtcgctgccgcagcatgagcaggtggtcggtgccggctctacgagccgctcgcgcggcaggtggtcggggaaaggcttgcgggccggccgctggcgggtaaaggccaccacattggtggtcttggccactgcctgctcggcagcgatctcgtcctcggtggccgatgcggccaactcctcgaacaccaattccatctggtcgatcagccgcgcggtgcgctcagcgcgggggccgtaaagcgcccggttcagcttctcgatctgcaatttctggtgcgcgatcacggcctggtcgtcggcggccttggcccttgccaccgccagttccgcctcgacccgaagcaacgctgccttcagcgcggcgacatcatcgggtggggggtggcggcggctcttcattccccgatggaatcataaattcaggccgatgactcccgaaaaatgaaggcagccccgcctatccagcgcttttcggacggaaggtgtggcgcgggctgcgccagtcgatcccgtccagcatataggcgagttgggccggcgaaatcgccactacgccgtcagccggtgacggccagatgaagcggcctttctccaaccgcttggcgtagagcgacatccccaagccgtcgtgccagatgatcttgatcatgtcaccgctccgcccccggaagacgaacagatcgccggcatggggatcgcgcttcaatgtctcctgaacctggagcgccaggccgttcatgccacggcgcatgtcggtgcggccgaccgccagccagacccggacattgctcggaaccgggatcatcgccgctccagcacgtcaagaacccgccgcagcatcgcggcggcggcatcaccgccgacacgaacacggtagccgccggccagttcgatctcgatccgatcatccggggagatggaggccgcgagcggcgcggcctcccccgtcagcaccaccggcatcaagcccggcgctatcacatcgatcccggacgggccaaaccgccgccgccatgtgaacacctgattggcgttgacctcgtagcgcaaggccaccgccgcgaccgaggctcccggctcgaacgtcgccgccacgatctcccgcttcagcgcctccggccaggaccggtaccgccgacgctctctcaaatttgtgtccataactggatttgtggacacattcgccaccatcaatgccatgccagcggccagtctctctcttccccatcagccggggaaggcggccgtcaccggaggcgtaccctgtatctaacggcgatcatggactgggcgacacgcaaggtgctggcctggcgactgtcgaacaccatggacgccgacttctgcatcgaggcgctggaagaggccttggcccgctacggcgccccagaaatcttcaacaccgaccagggcagccaatataccagcccgcgcttcaccgacgtgctgaaggatcgaggcatccggatcagcatggatgggcggggccgttggatggacaatgttttcatcgaaaggctgtggcgatcgatgaagtacgagtgcgtctatctccatgccttcgagaccggatcggagctgcgggccgggctcacgaaatggatcggccactacaacgcccagcggcctcactcggcactggctggacggacacccgacgaggcgtattatcaaaatgggccgacgatcttgccggggttaaccccggcaagatcgtccatcggcacagacggacaaatggcggcgtaaccacatccgggattagcttatttttgccgccaatctgtccgaatggacggggccacctctgcctgaacgattttctgaaagccgagactgccgagaaccatgcgaatcaattcacgcatctgcgggctgtcttcaacgataacggcgcgacggactgcattatccacgagattgatctccgttagaaaattccaaaccactgctcccgactgcgtccttaattgaggccaaaagcgggagaaacagcccttcgaggttgtcaaccaagcgcatcactctcgagatgtccgaagcctctaacccggcctcaatatcctctgtgatccccacaatttccttggcctcaatcataccggccagtcccttgaaggtatgcgcatctcgtcctgcagtttcaaaatcgcgattggcgattgcccggcggaggcggagcacaatatctccttgctcttggacaaagctttgaagtgaggaaaggtaaagcttcttcattcccgcgacgcgccgcaaacctgcacgaacatttaaaccacggatctcagagggcacgtgcagatcgcgtcccgacatggcattcattcctgctgtcccaagaatggatgcctcagctaggccggtgacccagttttgaataacaccgtagagttgctctggctggaacggcttgctcacaaaatcactcataccggcagcaaggcattcatccttatgctcattcatcgcattggcggtcatggcgacaataggcaaatccaacaattccacattttctctgattagacgtgtcgcggtaatgccatccattccaggcattctgacatccatcagaacaatttcatatttccctgaggccgctttttctacagcagcagcaccgtttcctaccacatcaaccaacattcctgcagcctcaagcaaaccaacggcaaccatctgattggtaagatcatcttctgccagaagaacttgcgcaccttgcaatatggaatggtcttgatgagcaaaattattatgaatttttatgggtgataaaaattttgatgggcaatcaacgccatccacagccccttggaactgcaccgtgaaccagaaggtacttccgctcccatattgactttcaactccagcctgcccccccattaattccgccaattgccgtgcaattgcgagccccaatccggtgccgccgaactttgctgaggttgatgcttcagcctgctgaaaggactggaatagtgtggcctgctgttccggagtgaggccacacccggtatcagaaaccgcaaaccgcaacttggtcggcggcgctgtcttccccccttcaatctgaacatcaacgtcaattccgcctgagcttgtaaattttaccgcattgctcaggtaattcaggagtatctgcctgatccgaagtgggtctccaatcaccccacgtggaacctctgaagcgattcgaacgttaataggcaatcttttttcagaggcttgcgcagcaacaacactgattgcctcgtcgatgagattggccagatcgaagggagccgcatcaatgacaaccttacctgcctcagccttagaaagatcaaggatatcgttgatgattcccagcaagcgttgagcagactgcttaattgactggatgtggtgacgttgcttcgcaggaagttccccacctagggctaaatgggccattccgataatgccgttcatgggagtacgaatttcgtggctcatattggccaggaaaagtgacttagccttgttagcagcctcagccacacttttgctttctctaagctgggcttcaatttctttgattgcggttacatcagaaccggttccacggtatccgataaacccacattccttatcgaataccgggacaccgctgatgcgaagatattttttcccacggccagtatcgatggcatagtcaaaatcacggaatggacgccgagcggataagtcaccctgatgatccacaagagactcaggagcaatttcagatattaggtattcccttgttttcccaattacctcctggggatcgagaccagttacatatgaaaatctttccgagaaccaagtgaatatgagattctcatccatttcccaataccaatccgacgatgaccgcgcaaagtcagaaaatcggtccctactattttgtacattcatctccataatttttcttgatgttatattagtatgaacaacgattgcaccgggctcaacaccagaaattggagaaatatccagcttaaaccaacgctgctccgtcggcgagtggcatggatattccagagaaatccctggtgactggccagtaatcacatccattagagtatgaagggtcaattgtggggggcattcactcgcctccataccgccgcatacagacccataatattcaccaatgcaaaatgtcgagctcccaccattctcaatagaaaactttcgccacgcttcattgacgagagttatcaccccgtgacgatcaagaactgcgatatgctgtggcatgcagtcgataatcaaggcaagcttatcgcgtgtgatcgctaattcagcagaatgtcggtacgcagtctcctctgcaacttttcggtcggtaatgtccattaccgtagtgaggcaccgccacccctcgccccactccgtcccaaggcgaacgcttttcaagatgattggaacgggtgctttttgatgtggcgcaagccgcgattctgtagaggcattgccatgcgccctcaccatggaaaagtgcccatccacctcctggcggacttttccatccacaaacattcggaatggcatgccaatgacatgggctctgtcgtttccaataagtttaaggcctgcaatgttgacatcaattattgaaaggcggtcatccagcacaaagtatcccactggagcacagtcaaatagatcgcgatttttgttattttgcttctcaatgtcctcgcgagcctgctgaagctcatcattctgggctttaagctcttcctcatggactcttaaattatgaagagtttcttcaagaaggcgctgccccgccccgggcccgtctgaaacaagcctgcgaagcgcaaggtcttcttcgtcctgcatctgccgctctgcttcgagctgttgcttgtcattcatattaacaccgcgctttatcgcgagaggacattattcctaaggttataaccattggagcaatgtgtttctgaatctagccgcagtcatcctctcgtcattagtccatggacggctaaagccagatttgacctcgatccatttttcgaaagatcgtcggggggagagcattaccacgcctgctttttccaccaccggcttgtttgggtttccagcccaagcgacttcctgggctagagcgggcctaaaccaataaaagcgcacccatccagaccgcaaggagcgcgcctttatggcgaccatgccactgaccacagcaagcaagacaacttgaccatgaaaaaaatcgtctaggtgatctgaaatcacgaccgtgtcacggctttcgttcagaaaccaatcgtctatcaaccccataccatctagatcaggggcctcaccggtgatcaccacatcattgcctatggccatagcaaacccctgtgcggccatagcctccatcaactgatctttcatcttgtcgatgccgtctagcgggtcttcgtgttgcgcaagagcctcaagaattttctcgatgcgccggtcgaggctatccagagattgaatgcgccgtcccgcaaaatgggaggtgagaccaaggctgtaggcattagtcagagagacacatgccgaacgttgatcatgagacaggaggtgaggtttgagactatgacaggcgacaagcccccacagcttgccggtaactctgataggcaccgagaaagaagctccaacccccatatgattgagatattccagatgaaccggggaaacgctgcgcagatcggaccaagctaaatccgcgggaacatcccccaacccgagcagcggcacgggctgagctgtggcgtctgggatcattcggcaaggattgaggatatagagattcctggcaatggcaggaatatcgctggcaggaaaccgtaatcctaaatagcttcccagtgccttcgtcgttgcctctgaaatgacttcacccgaccaatcctcttgaaatcggtagatcatcactcggtcgtagccagtcaccgtctgaaaggcttgcaccagcatattgtggtgctccatgacttcgtcatcatcatagggaacagacagtagtggggactgcagttgttgaacggggatgggtgcactcggcgcggcgcttcgctctagctcgataagaatgaaatcgacgccacgaacggccaacacgtccaatcgctcccccaaaaactctgcaacactatccacccgaagacgcttccccggctggtccggcagggcattgagggatgcaacgggcaggaagttcaatgcctccaatttttgacctaaaattattgcaggatcagttccgataaaatctgcaatatttgatgatacgtgcgttaccgttcccgacattgaatcgatgcggatcaacccgccaaaagactggattgcgccagacaaattcagctgctcggactcgcagcgttgtactagggcttccaacatggacagcgttgtcatgcattacctcttgagtggcttgcgggaggatttccccccagtctcaatcaccttggcgaacgcctctggtgacaaggggcgatggaacaagtaaccctgaaccatgtcacacccctcctccttcaagacgcctaattgctcctcggattcgacgccttcggccaccactcgcatccctaatgctctggacatatcgatgattgccttcgcgatggagcggtcgtccctctctagggcgatgccgtccacaaaactgcggtcaatcttaagctcatggataggcagctttttcaaataggacagggatgaatagccggtgccaaagtcgtcgatgctcaccttcatccccatcccgtcgaagctggtcagcatctccttcaccatgtctattcgttccatcagggcgctttcagtaagctcaataccaatgagctcggaggaaattcctgaactatcaagccatgatcctaccttagctgcgaatcctgcatcccgaagctggtgtgcggacacattgatggcaatacggggaacggtaagtcccttctctctccaataggctatctgctccagcaccatggtaaagacggtttcaccgattgctccaatcaggccgcagctttcggcgattggaataaaatgggcaggtgatacctcacccaaagtgggatcgcgccaacgcagaagtgcctcggctccgaccacctctcccgtatgaatatctacctgcggctggtagcacatgcgaaagcttttggtctcaagcgccagtcgcagcccagtttccaaggtcaggcgttgcagagcgatcaccttcatttcatcggcaaaaaactgatattggttcctaccccgctccttggcgcgatacatggcagtgtcggcatgcttcagcagggtaagactatcctggccatcatcgggaaagacgctaattccaatgctggcagagacaaataggctcttatcgttaatgctgaaggacgccccaagaaaatcgacgatccgggcagccacggagttgactttttcgagactgacatcggtcaaaacagcaacaaactcatctccacccaaccttgccagagtgtcagaatctcttacgcaatgcttaagacgctccgtcgcctgcttcagaagctgatcacccacatcatgccctaggctgtcattgatcactttgaagttatcgagatcaatgaagaggaccgccagcttggttttttgccgcttggcctgtgccaccgcgtgtttcagccgatccatcaacaagcttcgattgggaatcccggtcaactcatcatgagttgccaaaaactcgatgcgtcgctgcgagctcttgatcgcggaaatatcgctgaaaatagccacgtaattgacgaccgaaccgttttcatcacggaccgaatttacggtcagccattccggataaatttcgccattcttgcggcgattaaagatttcgccttgccaacacccctgctcaatcagggaacgccacatggcatcatagaagtcttttccgtgtttccccgattgcagaaatcgtgggtttttaccaataacctcttgatggctatatcctgtgatgcggcaaaacgagtcattcacggttatgatattgcctgagctgtccgtgatagtgattgcctctccagcacgatcaaaaaccttggcggctagccgcaattgctcttccgcatgatgtttcattgtgacgtcggtcgactgagagcaaaccgcacggaccacgccgttggagtcaaagatgggaaaacggacagagtccaaccaaacctttgacgtggggaacaccatctcctcaagatgctgaatggcggaaagctgccccatcacttcgaggtctcgactccttagcaattgagcgatgtctcgactgaagagctgctggtcggtcttgccaatcacttcttccgcagagagaccaaatagctcctcaaacctcatatttataaactcatagcgaccggccgcatcttttagagaaacggctgatgttgagtggttcatgatggacagaagacgctcttggctttcgcgtatttgctcctgggcctcaacaagatcagtatggtctacaacaactagaacgacactctgtggtgttcctgtcatgctcatggatggcgtgacaaacacctgaaatgtcctttttccaaacgtgatttggaaactttccttgcgttgctcggttagagccgcagtgaggctcttatcgatgttgtcgaggaaagctggtagcttgaggcgtcctatatgcattccgcttgctgagagtggcaagtcataggtcctgactgcagcgccattggccctcttcaggaaaagctcagggtcaaacaccataataggaaaatcaattgtgttataaacaccctcaaaatcgctattaatcgcggcaagctcggctgactttatcagactttcttcattgacacttaccagctcttcatttgttgcctgaagttcctcattggaggcctcaagctcttcattggacgcctgcaactcctcattagatgcctggacttcttcattaagcgcctgcatttcctcattggaggcagccatttcctccatcaaagtttggaggtgctctcgtgtcgatgccaactcatcgtcggggaaaacttcagcaccgtcttgtggctcagtttccttgacggcgttagcggcatcggcttgtgcagaacgttcaaaaactaccaaaaaagtgtctgcttcagccagttctcccactggatgaaccgccaaccgccatacctgtttgtccaaagacgaaatccgtcgcttccgactataggaactagcctgacgacgacgagcgcgatgcatcgtggtcaggatttcattggaaaactcaggaactattaattgagcgagattcatttccggcgttcccgtcggaaaatggataaatcgagaaaccggtccgtggctatgcaatatccggcaacctgaatcaatcagcattgccggtccaaaatggtctgcaagggcattcagaaaaagccgctcattcgatctgtcgggatttctcggctcatgtcttggaacctttagctgtccccttaccagctttcccatagtgataggacggctctgcccccgtggacggaagattctggcccgccgatccactgacgcaaacatggcctcctgctgggtaaccgtttcagagcgcccaagaaacagcagaccatcttcgcgaagcgaatagcgcagaatcgataaaaccttggcttggagatcagagttgaaatagatcatcacgttgcggcaggtgaccaaatccagccgcaggaatggcggatcaacattgacgtcctgccgtgcaaaggtgacgcagtcccgaagttccttggtcggttcaaatccgttgccacagggaataaaatacttcgaaacatattcttggggcatttccgccatggcggtctggttatagataccccgccgagcgacgctcattgcgttgttgtcgatgtctgtcgcaaaaacctggagacggcttccaatgcctctctcggaaactaattccgaaaacatgattgccagcgaataggcttcctcgccagtggcgcacccgaccacccaaactcggatttcttcaccaggaagtttacggctcacaatctctcgggcgtgcctctccaaggcgcgaaaggcatccttgtcccgaaaaaactctgttacggaaatcaacgtctctttggccagagcatcgagctcgtcgggatcgctatccgtcttgctcaaatattcagagagggttccggtattggtagcagccatccttcgctgtaaacgtctctggaccgtggacagtttgtagctggaaaagtcaatcttagtgcgcagtcgaacgcgctcaaacaggtctgatagctcagcgggccgctgttcaccactctcaagattcggcagcatgcctgggaagcgcaccaaacgctctaactcgcgcccaatctggtctggtgatacaatacgatcagccacacaggcatcgatagccgaacgcggcatgccatcatatttggcggtctcggggatttggacaaaggtaatcccccccgccgacttgattgccctcaaccccctcgtgccatctgatccggtgccagaaaggattattccaatggcgcgctcctcaaattcgtcggccatggactgaaaaagtatattgatcgagggctttggagagatttcaggagacgcctggctgaggacgaaacactcgtccttgaaaaccaaatttgtaccgggcgggatgatatatatgacgtccggttgggggcgttcgccatcggcgagttcacgaaccggcagtcgggtttcacgagacagaatgtccgccatcatgctgcgatgcgttggcgacatgtgctgggcgatgacgtaaatgcagccaaggtccaggggcagcccccctacaaactggctaagggcctccaatcctccggcagaggccccaattccaatcacatgcggcttgctgtcaacttttacatccatgcaactcagcctcttaccgcaacaaattcgcgtttgatttaagattcaccccataaccgagcaaaacaatttatgtagcatcttctaattttttaaacttacagacaacaaagcacaaatatccgacaaaataacttatatttaccgacctctaccatcgcatatgtacatgaaaatatatattccatcaagattctgcgatgctcaaaattggggagtgtcatagaaagtgccttttgtcaggagccggacacccggcaaacagcggccccagacgcttctcatcgcgggcttccgtctgacgacggcggggcacacggtgaggtcataccggaaactaagttgagttacccaggcactgcgcttgacctctgtacatcccgacccgagaataccaatcaaaattgggacgcccatttcccgcatgaccgccccatcagaatgccgacgatttatcggttggcgattattgccgctttggccgcctcctcgcgggcgcgacgaagatttgactcaagcagcttgacctcggcaaccccatcctgattgagaaaccgcatcaaataaggaacccgatcctctcgatccgcatggttccggcccttgttgtgggtgaacttttcaaggaatgcgacgtcgatattcgggaaagcaaaataggcaagcatgacaagaaactcaccggctcgatctgacaagcggtcaaacacctcaagcagagagtcacgcagggctccctcacgcgccttgtcttggtaggagcgccggtccatctcctgctcgtaaatttgcctcaccttgacccagcttcgctctagaaccagggtgtcatattcaaaaaggagagagcgaaatagatcgagttcgcggttgcgcacggtcggcaaatcatagaggtcagattccagcaatggccgaagtgactgtagctctttggaagcgactaggacttccttggtttcattgcctaccttcttggtaactttccgctggtatagggcttcccaggctccattccagctctgccgtatgcgctcagcactattgggatcgttttcgataaaagaccaaagatcgactgctgttgatgttgctggattccatttccacgatgatccgacaatgctgactgtgcggcttttcatcattgcgggaacaatgtgtgcacggaccactgcctcaaacttctctgaaaagtccggggagagagcaaaagatggcttcaaagtgcgtacgcactctgggttgcggcgatgaaagaaagacaaaattgatcgaggacgccagcacatcgcgtcggcaaaaatgtcctcgaaggaggtgtgaggcggataactcggtgcctcaacctcaataatggctgtggcctcgacgacgccctctagggttgacgaccgagcaagcagcattttgtgtttctcggcgacagcacgaagtgtttccatgctgaattggcgcaaaataagaagcttttctggtgtggtcgcgttgtttccgcttgcgtgatgcgtgaagaacaggcggatcatctcgtgcaaaggcgctttgtgttcgcagcgaggcaaccatgactcgaccacgcgatccaaagcagcgcgcaactcggcagcatctctagcagcttcgagttcctcaacatgtgatgaaaacggcgatgggcaattttctctgcgcccggcacgatcaaccggcattttttcctcttgtctcagcctgcgtcccccttggccaggcgattacagccgtgcttcactaacatttgatctggagccgcccgtgggggccggtcaccggacagatcgccatcgacagggcaaattcagacaaatttttatcactgggcttggatttctggccgacggtatcaaccattctctttcagagaccgcataacgtctgcctgactcgcggcaacctgcaactcatcatccatgaaccggctattgcccaggggtttggtagcgcagccccttttaccttgtgtcaattcaaccagaatgaaatttccctcggcctcttggatccgatgaacatccctccaagccctgctaagagattgtttcattccatcccccaattttcgcgccccgcccatgaccataacgatttcctcaaccgcgccaagcctttcggaaagcgtctccgaacatccaagcggaaactcatttcccattatgatgcggtcaatatcggaactaacaatttcaagtctatgctgggcaatgtccgccaaaacctttagaaacgtgcctttgatggcatcgagtttctcaagcaggatattccctttctgaccgtcttggggatagctcagatcggccagcgaaagcaaattgaccagcctgtgagcagcttcatgcaacccttcgcgcaaccgctgccgcgtcgaggtattgtcagtcgattgcatgtcctgcctcagacgctcgatgcttgtcgcgatcttgttcacgccattaaggatagtggcctcccgtgcagacagggatgggatctcctcagcccttggaaggactggtctctgcccattatccctcatggccggagcagactgcacccctcttggcatcgacgaaccggaaggtggattcggtggttttgaatgttggctatctgtcgcccgccgacgcgggccgctatatttagcgttgcggttcttcccgcgccgacaagggcctcgataattatggtgagcaataaactccctactgtcggtcatggcgcgagtaaggttcttcaacaggctccgcgtaccgataggcagcgtcatgacgctgttcgccccggaattgaggatcatcgacaaatgggctgggtccatgtttccggttaggtagattatcggcaccgccgccgctggcccgcgacaatcccttcgaatgcgtttgaccacctccaccgaaccagcaaactcggcttcggcgcagatgactgcgtcgtaggccgactgggaaagctcatagatggcggcttctatgtcgtcggccttcgccacgttggggaggccgatctgatgcagggcggtaacgatgagttggcgaagattgccagcctcggcaatgaccaaacaggattttccaaagaacgataggttcagcgtcatcactgccttcaggctcgtgtcttctcaagccgccaatgcggaccgggatcaccgccagcatgacgtcccaggtcatcgaaagacctaggaaggtcggtaagcgcagcccacgcagcctctgcctcggccacacttgcgtctgcattgtctgagatgccacgcactagctccagaacagcaacatcagcatcatttgcgggctggcaggtgtttctccgagcattcatgtcaggcatgtcgtgtttccggcgacggtggatcgagaagcctttagaaagtggcaggttctgcgtaaattagaacaagagccacgccttgctgtgactgcaacggcgttgaaaaactgtggttatgcagccgatatatgcggacccccatagtgactaggccgcctgacccaaaagcaatcgtgttggccgagcgatatggctgtcgagaccctcgctcggcctagctacagccccttgattggcgacaacaagttgcggctaagtcaaatttagcacgtccttgatcacaagtgtcgagtccagcttcgtgataatttgttccatcacgtgacgggaatttagcgaagggttcggaacgcgtcggcggcttggcccattggtctcgtggcaagcagtctggggcaccctttgccctcgaacgctctccttgccactccattgatcgtaatacctagctcgcgtaggctgttcggatgatcaatatccagcagcacctttcctcaataatccgcgacaccggcttcacccgtgtcaggcaattagtcatttcatctgaccatcctccttacctgacgcggcatcgcgccgaaaccattgcctcacgtatacgaatagtcgccagtgccttctctcttctgaccctggcatggatcgccctcgaccgcttggtgctgccttggccaagctggggctggctggccgggttgaggttgtttgcgtcgctcgttttcatcgtacttgccgtcgcatcccatcgcggggtgacgctgaagcgggccttgtttttgctggcagtacttctggcgttgccgttggccctttttctggccgctcagttctcgctgtcgggactgccacttgataatgctgccgcaatcgatgcgcgcctctatgctgccctaccgatcatcatcgtcgccggtctgggggttatgccactgactgtggccgaaggactggcatacgcactgcctgttatcgtggcggcgacgctcggcccgattctggccaatgggatcgactgggttggtcagctgtccaccatgtgggtgttgggtatgatcttgggggtctatcttctggagagcatgatccagctccactacatgatcagactactccagcgcgccagccacgacccgctcaccaatgtcttcacccgccacagcggcaacgaaatcatcgacacacaattccgactgtcatgccagcgggatgctcctttcgccgtggccttcctcgatcttgataacttcaagagcgtaaacgatgcccatggtcatgaggctggggactgggtgctcaagaacgcagtcaccaaccttacccggctgctgcgcagttcggacaccatcatccgttggggtggcgaggagttcgtggtggtcctcggcagcgcctccgctgaaggccagcggatcgccatccaacgcatcgtgaacgagtggctgggcactcgccccgacggccaaccagtgactgcgagcatcggtgtcgccgaacgcatcgccgataatgcccaagactggccagcactgattgaactggccgacgcccgcatgtatcaggccaagatgtcgggcaaggctcaaggcatcatgagcgcggacgaggtgatcgttcctaacataacgccacacgccgccccgcagtcttcggcagaccgtttaaacgtctgagataggtcagcctgagctgtagccgaccgctctacccagacacccgtcgttcacggcgaagagcccccatgtgctacaaccggtcgtccttgggaagcgatcaggattggtccgcaccatccttgagcgtgaagaagaacgtcgtgccttcgcccagctcagactctagccaaatctcgccgccgaaacggtggacaattcgccgacaaagtgtcaggccgatgccagtgccatccttgtaggacatagggtcaagacgctgaaatatatctcgaagatcttgccgtgatattgcgactcaataccaatgccgttatcggatacagcaaagcgccagtcgttgctgggcatacgttccgcactcaccgaaagcaccggcctgcggtctggcgcactatacttgatggcgttactgagtaggttctgaaacaaactgacgagatgggtctgatcggcgataaccgtcggcaaatcaccgactgtaacctctgctccggatgaatgcaggtccagttcaagatttttcaaagcccgtgctatggcatccccagcaggtatcggtcttaaaagctccaactgttgcgatgttcgggaaaatgccaaaagatcgtgaatcaaattggtcatgtgcttcccgccttcagcgataaagcgaaggaaatcgtcagcatctgagtcaattttccctctatatcgatgctcaagcagctgggcgtatcgaaccatattacttagtggagtctgtagatcgtgtgatgcaacataggcaaattgctcaaggtcagcgtttgactgctccaatatcatatttttatcatttagcgcattttgggcctgatttttttcgtcgatcaaacgttcgttaaccatcaagataaacgaaatgatccagccgatgacaaagatgatctgctcgaacactacagatgcgttgatcgctgtcagcgaatagatgtccttaaccctgtcgctgggattagacagagccgcgctgacaaggaatgaaatcgacaggaagagcaagaatgctgacgcagccagatacgaagtcatcctggtcttacgaaattctgagatggtcacagtgaaggcccatagggatgtcacagagtagaccagtagatagcataagagtcgcatcttaaaattgtcatcaataaaaaaataataagcgtattcagagccgtaaatggccaagccacccagtagcaagcgccagtcagcccttcttcctgtgaactgtaaaagaccaaaaagaaccagcgcatatccacaaaatatggccacattccctgcgacaaatgaaagccatccgggcagtacagctcgcaatgctatagccccgaagccgaaagcgaaaaatgaattagacagggcaacagccaggacgccgttgatggccctgttgttgatgaataggaaccacgcaaaggcgctcgccaaaactgacgctccgccaaggacgaagaacaaggtggatatgtcgagtttcacccgtcacccccccgcatacagaaacgagagtcaggaaaattgatttcgtcatgagacgacctattgggggacacgcgacaaatcacgcagcccctaccggacccagaccgccaccacaccagcgatagcggcagccactgccagccatgcaaaccaaggcttggggcggcgacggactggcggcggcgcagatagtccaaagtaccccataacgcccccacatccaaagcagatgaccgaccgggtggctgtcgaaggcgacccagttggccttgtgagggacagaactgtcgaatctcctccctatggaaatagggctatttcttttagcccggttaatagaccaatacggacgaacaaacagttgatgagcggggcaagccttgagcatccggcacagagcccccctgtccacgtcctggatattcgccgtccctcagcttcgcttaccctgggtcgctcttatagcactggcccgcttaatgtggctggctcttcaggaaatgttcaaaaggactagaaacatagaccagaatgctcgagcctacgactctagctctccctccccttgattaatgccccatgcccgcgtgatggctcatcatcagagcgtcggcggtctttttttgctctggggtcagggtgtcgtaaaagccggtcatggcggggatcaccttacccatgacgctgacacgcgcctccatcatcttgcgcatacgctccatgtgggtcgggagtgtggtcgcggggggctgggcaacgatctcggcgcaaacctttttcatgggttcatgagcggccttcatggtttctttcagcttggcgaaagccgccttctgagactcacccagtgccagcttcacttcagcaaaggcaagatgccccgccatcttggcgtccatgtcgccgcacatgacctgcatatggtccggcgtggaggggctggccgccatgtgagccatgtgatccatatgatcggcggcacgagcggcccccgtcgcagcgaccacaacaacgatggcaacggcgcagcgggaaagaaacttcatagtgttacctcctggtgggaatccatgcggagatttatagaaccctaatgtattgggcgaaagcaccatttacgtccaagatggaatggtcttacgccttcaccaccggcagttcttcccaactggtcgtgtaactcggcgttcgattgtcgcagcgcatctgccagggtgcgcccttcggggccaagccgtagccgaccgctcctttgcccagcttgctattgagaccgtccacggcagccatgagcgccttgggtttctcgccagtttctggcgttggagaaaacaggtcgcggggaatgtcttcgggccgcacaagatcgagcatgatcaccccggccttcttatagccgtgacctcgggtcgccccgccagtttcaccggcagactgtcggccatatggatcagcagcacataggctactacttctttcggaaccctagtcgcgtcagcataaaagtctgccgctatgcaattacgattccgcatcatggtgatctttcggtcaaacgctcccgaagctttgaacagccgatctttcatcccccgcacatccctatttcttttggccgagtcaatagatcaatacggacgaacaaccggtcgatgagaggggcggccccgccaaatggccgagttcggttagttggagccgattggcccatcgccgcgtctgacagctccctttacgctccaatgaaggccgagcgtggtccaacgatgatctcctgcaaagagcgaccacactccgagattctcatagctttcatcgggtgattgcccatcaatctccaggcggcaggcaagatcttggaaatccacccctgtggtttcccggccaggggcatgacagcacgaacaccatcctatcgggagatggggtgtggcggcctcgagcagatagagcagttcgtggacgtcgcaacccggccgaactcttgctgtcagggatgctgggatgaggtggtagccgacgtaaaccgcgtcatgcaggcacggttcctggcaaggggttctgatgatcgaggccaccactccggaaaacccagagggtatggagggcatctgggacggtgacagcagcgtgatccgaccaaggatgtcttcgatggttacatcggctggaagccgtccggtaagcggcataattggttgattggaatccatggggcctcctcaaggaggtatttatccagcaatcggcatccagaacgatccattcccacggcctcgaagtgcctgaacaagcggcttgtcatcaacgcatctgaaacagttcctgatggaaacgttccggcggcaagccgttggcaacgaaattctctcgcagtgcctgaccaaagccgggcgggccgcagaaccaaaaactggccgactgccattccggcaccacagcccggatgcgttcgccgttcagtcgtccacccttgccatcgaccaggaggtgcaagcgtacaccggcagcagtggcatcggctgttagacggtcaatggcagtttgatcgaactcggttgtcgggtgaaacaaatcgatggtcttgctatccgaattggccgcacaatgcttgagacgggcgacaaagggcgtgatgccgatgcctgcgccgatccagatctggtgtgactgcgtatcctcaaagtcgaagcaaccgtaagggccttccaccgtcaccggcatgccaatcttcaagcgttcccgcaaacggctggtgtgatcgccgagcgccttggtgatgaaggtaaggcgatgatcagccggattccaggcggaagcgatggtataggggtgggctccctctttcttgtcggaggtgacgaaggcgaattgcccggcggcatggccacaccagccgtcatccagcacgactgtggtttcgagaacgcgcagggccgggtagttgatcagggactcgatggtgccctgcactttacgtccggcaccgatgcggcctgtcagggtcagcacggcggcaacgctgccgcccagcagcaaagttgccagcacccagccgaccggctgtgtccagtagacgaatttagtgagcacagcagagtgataggccagggccaggtaggctgctgctagccatttgtgggtcttgacgaacaggtgatagggaaagcgcttgaccagggccagaacgatcaaagtcacggcggcgtagaacacccattcgcctatggattcagccagcccccgctggctgcgcagccagccttcaatggcaccgagcgtctggtcaacatttggtttgcgggcgggtttttccagccacccccagccgaccatccacttggtgccttttgcccaccaccagtgcaggatggaaaccgccaaagcgctgatacccagccacttgtgcaggcggtaaatcttgtccagcccgtccagatgcggctccagccatttcggtcgcagcgccagcagcattgcgatactcatcaggccgatgccgagcaccccgctgtattgtacaaatacgccacggaacgagaaataggtgaatggctccggggacagggtatcggcagccaaccatagtgcagtcagcaggagtactatggcgacgagtgaaattttgatgcgcttcaagaatgaactccgacgaaatgccccatgaccttccccaacgtggtcaacgatataccaatacggaaatcgtcgaagggcgtgtaggagtttttgtgtaaacggtcggctggaagccgcccggtaagcggcataattggttgattggaatccatggggcctcctcatggaggtgtttatccagcaatcggtatccagaacgatccattcccacggcctcgcactgcctgaacaagcggataagcgagcttccttcgaaggaaggcaaggatctcagcctcgacctcgatttggggcaactgtggggcaaggccccaaaaaggtttaggccccagcttctgactggggcctaactccttgataacaaggcaataaatggtgcccaggggcggaatcgaaccaccgacactgcgattttcagtcgcatgctctaccaactgagctacctgggcctcgtgcgcctcgcggcgaagaggaggcgcttataggcgactttcgccgccttggtcaagcccccctgaggcaaaaaattcaatcttcctcggggaggccctcggggtcctccacggcgggcgcccgataggattcgttcagccagcggtgcaggtccacatcggcgcagcgagccgagcagaaaggcttgtatttgggctgggcgggcttgccgcagatggcgcaggcgggcgccgtttcatcggtcatcggatcacgtcctcgatcagcacgtcctcggaggcgcgggaggcgtcttcgcggatggtcagggggtggcccaggcggcgctcggcttccgcacgctcggcggccagggcggctagggcggcggccaccgggggggcggcacgcagggccagaatcttgcccggccgggtgaggctctcggccagcagggcgcgcaaggccgccagggccagggtctcgggcgtggcggcctgggtgcggcggcacagcagctcggccagggcgggtccacgacgctcgcgggtcagttccaccagccccaggggcgacaccccgaatacatgggtgggcgtcgagtcggccgccaccgcctgcttcagcgcctcggccagccggaacaacggcttgcggtcgcggcccgagacgaaatccaccaccacctgtccgccgatgcccctgaggcgaagctggcgggcgatttccgtcaccgccgccccattggcctcggccgggcgggcgccggccgaatccacgtcgatggcggtcagggcggcggccggctcgatgaccaggcgcccgccgcctttcagcggcaccacggggtcgagaaccgcctgcagcacctcgtccacctcgtggtgggcatcagtgacgatttcggcctcggaaaaggcggcgcgcagacggtccagcgggtcgggacggcgcaatagggccggagcctcgcccgttgccgggaaatccccggcgggggtcagcagcggccccttgccgccccggccttcggcccgcaccctcgccaccacggccgaaccctcggacaggcccagcgccctggccccgggcaggaagccggggcgcggccccgtccccagatccacgaaggcggcgtccagccccttgtccagggcggtgacccggccacggaacacgctgtcgagcaggagggagggacggtcgataaccagctccagcggctggccgtcggccagcaccagataacgggcctcgcccgggccggcggagatgaggatctcgactcgcccgctcacggggcgaagccgaacccgtccagcaactgcgccgtctcgaacagcgacaggccgacgatattggaataggagccctggatatcgcgcacgtagcgcgccgccagcccctggatggcatagccgcccgccttgccgtcccattcccccgaggcggcataggcggccatctcggcatgggacaggcgcttgaaggtcacggaggtggtgacggtacggcgcccgatgcggccgtcgggggcgatcaggcagatgccgcccaccacgcggtgacggcgtcccgacagcaattcaaggcattggcgcgccgtggcctcgtcctcggccttgggcaggatgcgccgtccgcaggccaccacggtatcggcggccagcacgaaggctcccggatggcgcccggccacggccagagccttggcctcggccagacggcgggcgtggggaaccggcaattcgcctttgaggggcgtctcgtccacatgggcggggtcgacgagaccgggcatgatggcgatctggcgaagcaggtcgaggcgcctgggcgaagccgacgccagcaccagaacggccatgggattacttgtaacggaaggtgatgcggcccttggtcaggtcatagggcgtcatttcgacgttcacccggtcaccggccagcacgcgaatgcggttcttgcgcatcttgccggacgtatgggcaagaatctcatggtcattgtcgagcttcacccggaacatggcgttcggaagcaattccgtcaccgtcccagaaaactcgatcacatcctctttcgccatttggcctccgaactgggttttgcgcgcgcgaagataagtgagcgcaggcagggttttggtcaagccttttcgagcatggaaggggttattattcccgcgccatgcccgaaggcgggaaccgcttgcggatgtggcgttccaattcatcgcgcaccgcgcggtaggcatcgaggcgaacctcgcggctgccttcgatcagggtgggatcgaaggtgggccagaactccacctcgcaggcgttgtgccgggtcaggtccaccgccttgtgctgggcctcgggcgacagcgagaccaccacgtcgaagctgtcgtcctccagttcctcgaacaggcgcggcttgtgcttggagacgtcgatgccgatctcgtccatcacctggaccacgaagggatcgggctcgccccggcgcacgccgacggaatagacatagacgcgcttgccgtggatgcgcttcatgatgccttccgccatgggcgaccgcaccgcgttcatggtgcagcagaacagtacggcggagggcaggtcccccatctcccccctaccccctgatatggaggacgcagatcagggtgaacaggcgccgcgccgtatcgaaatccacgtcgatcttcccccccaggcgttcgcgcagcaattccgagccctcgttgtgcaggccgcggcggcccatgtcgatggcttcgatctggctgggcgtcgacttcttgatggcggcgaaatagctttcgcagatcatgaagtagtctttgacgatggattggaaggtcttcagcggcagcggcacctgcaccagcggagtctcgtcctccttgcgcacgtcgaagatcagccgcgtgtcctcgagcttgatatagagggcataggggccgatgaaatcgccattgggggcgaagtaattctcttccagcaggtcatagacggcgacggcacgttcgtgctccacctcggcggcgcggcggacctggtacttctccaccaactcgatcttggccagcttctggcgatgcggcatcagccggcccccaggttgagccgtaacgccaccgacagaccgtgggcgccgaggccttccgcctcggccagacgcaccgccgccgggccgatggcccgcagggaatccgcgtcgcagcccagcagggtggtgcgcttcataaagtccagcacgccgaggcccgaggagaaacgggccgagcgcgccgtgggcagaacatggttgggaccgccgatataatcgcccaccgcttcgggggtatagcgccccaggaagatggcgccggcgttcctcacccgggcggccagggcgtcgggattctccaccgccagctccagatgctcgggcgcgatgcggtcgatcagcggcagcgaggcctccagatcgggcaccacgatgatggcgccgtggctgtcccagctttcccgggcgatcttggcacgcggcagggtcgccaggtgcgactccaccgccgccgccaccctttggccgaactcggcgtcatcggtgatcaggatgctttgcgcggcggtatcgtgctcggcctggctcagcaggtcggcggcgatccaggagggatcgttgaagcggtcggccaccaccaggatttccgacggcccggcgatcatgtcgatgcccaccgtgccgaacacccggcgtttggcggcggccacccaggcgttgccggggccgacgatcttgtccaccgggcggatggtcccggtgccataggccagcgcgcccaccgcctgggcgccgccgacgcggtagatctcgtccacgcccgccaccttggcggcggccaggaccagcgggttgagcacgccgccgggcgacggcaccaccatcaccagacgctcgacgccggcggccttggcgggaatggcgttcatcagcaccgaggagggataggcggcggtgccgcccggcacatacaggccggcggcggaaaccgggctccagcgcagccccagccgcactccggcggcatcggtgaaggaatcgtcgacgggcacctggcgggcgtggaaggcgcggatgcgctcggcggccagttccagggcacggatcagttcgggatcgcaggaggcataggcggtctccacctcctgcgcggtgatgcgcagggtggcaggcgtcagctccagccggtcaaaacgggcggtgtactcgatcagggcggcgtcgccgcgactgcgcacttcggccaggatggcggccaccgcctgatccacgtcctcgtccacctcgcgcttcatggccaacagggccaggaaggccgcttcgaacccggaatcgcgggagtcgagactctgcaccatcagcctccgcacgccttgcgaaacgcttcgatccagccggccatctcgtcgggacgggtcttcagggcggcgcggttgacgatcaggcggctcgtcacctcggccagcacctccacttccttcaggccgttggccttcagggtggcgcccgacgacaccaggtcgacgatgcgggtgcacagtcccagcgacggtgccagttccatggcgccgttgagcttgacgcattcggcctggacgccgcgcgccgcgaaatggcgcttggtcacttccgggtatttggtggcgatgcgcacgtggctccagcgccgcggatcgtccgaggcggccagatcgtcgggctcggccaccgacaggcggcaggcaccgatccctaagtccaggggcgcgtagatctcggggtaatcgaattccatcagcacgtcgttgcccgccacgcccagatgggcggctccgaaggccacgaacgtggcgacgtcgaacgagcgcacccgaatgatgtcgatatggggatggttggtgccaaagcgcaacagccggctcttcggatcgtcgaaggcgggttccggcaggatgccggcggcacggaccaggggcatggcctcgtcgagaatacggcccttgggcagggcgatgaccagtttgtcttgcgggctcacggcgattgaaactcatatcttccggggagccctgtttacccggtttcgcgcccccgttccagtgcggagaaactatctttcgtctgttaccatcggttaccgaaaagcaaccgacgccggagagccggcaggctataacggatgccatggacaacaccaatccacatatcctggtcgtggatgacgaccgcgaaatccgcgatctgctgaccaagttcatgatgcggcacggcctgcgggtcagcgccgccaaggacggaatcgagatggccagggtgctcgacgagcgccgcatcgacctggtagtgctcgacctgatgctgccgggcgaggacgggctgagcctgtgccgccgccttcgggagacgcgggccgggctgcccatcatcatgctgaccgccatgggcgaggacaccgaccgcatcgttggcctggaaatgggcgccgacgattacgtggccaagcccttcaatccccgcgaattgctggcccgcatcaaggcggtgctgcgccggacccagaccgccgaggaggccccggctaaacgcggcggcgccaaggcgtgcttcctgggctggaccctggacctggcgacccgcgacctgcattcgcccgacggcgtgatggtggcgctgtcagcgggtgagttcggcctgctgcaggtcttcgtcgagcatccccgccgggtgctgtcgcgcgaccagttgctggatttcgcgcgtggccgctcggcggtgcccttcgaccgctccatcgacatccaggtcagccgcctgaggaagcgcatcggcgacgacgcccgcgacccgcagatcatcaagacggtgcggggcggcggctatctcttcacccccgaagtggaacggtcatgagctccttgcgcgccaagggactgagggtgctgcccgacagcgtggtggggcggaccgccctggtgctagtcgccgccctgatgatctcggcggcggcggcggtggtgctgttcgccgcccagcgccaggaagcgctggagaccatcggcggccgcaacgccgccgaacgggtggccggcctggtcaccctggccgagcaactgcccccggaccagcgccaggacaccctcagcagccaggaatcgtcgcaattccgggtgggctggggcccgcagcccgcagcctggacaacgaggatttcggtctggccgcctatgtccactccgccctgaaggaagggttggacgggcgcgagatcaaggtttccacccgtcccggccccttgggcaacggccccagcaccggcgtggggcgtggtggcgggcggcatatgcatggccccggccccggcttcgccgggccacccgaaaatcgccccggctttggcgggccgcccgacggccgacccggctttgggggacccggcagcggcggcggcggcggcggcagggtgatcggcccggcgctgcgcgtctcggtgcatctcaacgacgggtcctggctgaacgtgctggcgcccctggacctgggcgatcccctgtggcggccgcgcttcgtggcgccgctggtcatcgccctggtactggtcaccctgttctccctgatggcggtgcgccgcgccacccgccccttcgccaccttcgcccaggcggccgagcggctgggggtggatgtctcggccccgccattgcccgagaccggcccgcgcgaggtgcgccaggcggcccaggccttcaacatcatgcaaggccgcatcacccgcttcgtccaggaccgcacccagatgctggcggccatcagccatgatctgaagacccccatcacccggctgcgcctgcgcgccgagttcatggacgacgacgaccagcgggccaagatgctatcggacctggaagagatggaggcgatgatcgcctcgaccctggccttcgcccgcgatgacgccgccagcgaaccccgcctgcgccttgatctggccgccatgctccagggcatggtcgaggatctggacgatctcggcgcccgctgtagctacgagggaccgcaatccctggtgctggaggctcgccccgccgccctgaagcgagccctgtccaatgtcatcgacaacgccatcaagtatggcggctcggcggcggtggccctggaaaccagtggccgtgaggcgaggatcaccatcgacgaccaggggccgggcatcccggcggaggcgcacgaacgggtcttcgcccccttcgtgcggctggaagcctcgcgctcacgcgataccggcggcaccgggctggggctggccgtggcgcgggctgccatccgcgcccatggcggcgacattgccctggccgaccggccgggcggcggattacgggtgacggtcaccctgccgggtatggggcggtaggactcagccttccctcttgggcggggccagtgagatttccaccttgccggtgaagggccgaagcgtcggcgccggcttgggccggggcggcgccagggcgatatcatcgccatcctcagcctccagcttggccatggcggcttccacggcggcggcgacctcggccagttccgcgtcggaggactccgccggagcctcttccgcctcggccagcaaggcccgcatgtcgtcttccgagaaaccggccccggcaccgatctcgggcaggtcttcctcgggcagcggctcttcgttgttttcctcgagcagggcggcgatctcgtcgtcgctcatggcgccgcccaggtcgaacagcgagggcggtggcccgtcgggagcacacggtaccgcctgctccgacagcgccgccagatcatcgtcggaaaagcccatggccgagccgagcgccggcaggtcggcggcggacggcgccccctcttccccctcgccctcttcgctttcctcaagcagagcggcgatatcgtcgtcactcatggcggcatgaaacgagaaatcgggcttgggcaccgtctcgtcagccaccagttgcgcgtcgaattcttcttcctcggtcgcctcggccagcaatgccgtcaggtcggcgtcggacaggattgtggaggtcaactcggcacccgggggatgcagatcctcctccacctggtcttccgggtcgcccatggcgagaatcccggccagatcctcgtcggacagggtgccttccgcttcctctccggccggaggctcgacggcactctcctcctcgtcgggtccggcctcttccagcagcgccgcgatatcggcgtcggacaagatggtggagccgaggtctcccagttgggcgggggcgcacggagccggctcctcgtcatcccccaggtcggcgacttcgcccatggacaagatggcggcaaggtcgtcgtcggacagggtgccttcctgaaccagcgccgacgcgtcgtccagaaggacggccatgtcgtcgtcggacaggatggtcgaccccagttcgcccagatcggccggggcggcgggcgcgggctcctcgtcctcgcccagctccgcgacctcggccatgtccaggatggcggccatgtcgtcgtcggacagggttccttcggaaaatgggaccgagggctggtcgtcgaggtgatcctgttcgtcctcgacgacggaaggctcctcctcgacgatgggagactcgtcctcggcgaccggcggctcgtcctcggtgaccggcggctcgtcctcgacaaccggcggctcgtcctcgacaaccggcggctcgtcctcggcgaccggcggctcgtcctcgacgaccagcggctcgtcctcgacaaccggcggctcgtcctcgacgaccagcggctcgtcctcggcgaccggcggctcgtcctcgacgaccagcggctcgtcctcggcgaccggcggctcgtcctcgacgaccagcggctcgtcctcgacgaccagcggctcgtcctcggcgaccggcggctcgtcctcgacgacgggaggcccttcctctgccggagccggttcgtcctcggccggaatggcgcgcatgactgccagcaattcggaggacagcaacgcctggagattgggctcgggcgactgcggctcttcctcgaccgctggggaagccatgacctcggacgacacccggcggcgcaggtgatagaccgtttgcttgccgaaatccttggccagcgacagcacgcccacatattcgcaggcgaaccgctcggcgaaatcctcgccccggttctgggcctccgagcgcatggcgctctgttcggcggtcaggacggcgacgaattgctgggtggcatagacgtggccgatcaccgtcaccggctccagccgggcggcgcggttgatgtggctgccgtagaagttctgccggccgcagatggggtcgaccgcctggaacaccggaccggcatgcagggaaatgcgcaggttcagcggatggggcaggcggtcggccagctcctcgtcggccttcagcaccatctcctgcagggtctgggcgtattcggccatgggcgaggccttgtccatcaccgcgaagatggcgtcgccccaggtgttgatggccaggggctgatgttccagcccagccatgccctcggatatgatgcgcaggaagtcgaggaacaccggggtgtgttcctccttcagcttggaatagccggcgatgtcgcagaacatcatggagcggatgacgcggccttcgcccttttcctcgtccccgtcgccatccaggtcgggcatggcggggatgtagtccccggccagatcgggaaattgctgcagcaatccgtcgagatcgatgatgcgcaggcgggagatatcctcccactggtcgatgaaatcggcggcgccgcccaccagcgagccgggcatcatgtcccacaccgccagcagatagggcgccgtgcgcaggaaattggcccgcagggtcgccaggccgtgcaggcactgattggcgaagcggtacagcatgccgtggccgagatagcgctcctcggtggcataggtcacggtattggccagcttcagggcgttgcgaaagcgcatttcccagcgcgagccgccatagcgcacattctcggcgatgaaatcgtcgatggcgtagggcatcaccacgttgacctcggcgccgcgctccagcatggcctcgatgaacagcaggtccgagccgcaggcggccatggaatagcccacctgggcgcccagctcatccagggacttggcgatctcggcccgcaccgccgcctccagctcgggcgggaagtgcggcccctcgcccggacggtcgaggggatggccggtgaacaccgccacggtcggcggcttgatgatgtcgaacaccgcctcgggaacgaccagaccgccttcctgcagcagggccagctgcttgagcgccgccaccgtgctgccgtaatggatgccttccagggtgctggcccaggcgaaggaggccagggcgtcctgcacctcgcccaacagcagatgcgcctcggccacggtgaccagcaattggtagcgctcttccggcgacagcgacaggtcggtctcggcgtgggacacccggtcgcggacccggcgcgccagttcgcgggcgccgtcgtgatcgcccagcagccacgaggtcaccgccgcgtcgatgccgtcgcgggacgcgttgctgatgtggaaggcgcgcaggaacagctcgcggcaatgttcgagatcgccccgcagccccgaggccagccaggcctcgcggaacaccccggccagggaggtgtaggtctcggcatcggcgctggccaccagcttcttgccgcgcaccagttccagcgcctcggccagttcggccatggaggccaggtgtcctggctgtcggcctcgtccagcccctcgacggcgcggcgcagggagttgtgcaggcggtggaacggcccctcgtcgatcaggatgacgtcgagcaccggctgcagcaggcggcgcgcctcgtccacggcgccggtctgggacagcgccacggcgccgaagatggccagcttgaagctgtcgggatattgccgcaggccgtcgcgcgccgtgtcgtgggccaggaagttctggccctcttccagcaattcacgggtgatccgctcccactcggacaggctgcggagcgtattagcgccggcgctgatcggggtcgaatccgccaaggtgggccaaaccttatcctatgggtctgaatacctgtgtaccatgccccggcgcgagccgaaagagggcctggaaatcctgtccttgggcaataggcccgtgccgccgaccccgtgccggctcgtgaactgccggcatggattcagacggatggactcggttcccaaccgctagtatcgtgccatcaggttatttttttatgagaggagacggatttatgaagaagattattctggttgcggggaccgttctgctgctggccggctgctcgggccgctgggagcccttcggcggcttcaccgatccggtgtgcatgcccgatggctcggtgtcgttctaccagcagcccgacgacaagggccagctcggcacgccgcgcgccaccaaggaaaactgcccctggaacaaggccaagtaggccttccgacagcagttacgaaaagggccccggaaggggcccttttttgtctcactcttccgggggaaccggccgcttcttgccctggtcgtccaccgccacataggtgaagaccgcgctggtcaccttgaccagggcatcgctgccgccatggcggcgcacccaggcctcgacccgcaccgacagcgaggtccgccccacccgcaggatctcggtgtagcagctgacctcgtcgcccacatagacaggctggtggaattccatgccctccaccgccacggtgggggtgtggccccgcgcccggcgataggaatgggtgccgcccgccaggtccatctggctcatcagccagccgccgaacacatggccgaaaggattggtgtcggcgggcatggcgatggcccgggtggacaggcggccgcgcggcgccccgctgatttcaatgctctcgctcatggattgtcccgatcttacaatatcttgtggttaactccgacgacgctacagcatgcgcttgcgcatcgggcacgcatttctataatgccagccatgtccgacctgttccagcaactcgcccccaaggcgaccgaatactccgccaaggacatcgaggtccttgaggggttagagcccgtccgccgccgtcctggcatgtatatcggcggcacggacgaccgtgcgctccaccatctggtggccgaagtgctcgacaacgccatggacgaggcggtggcgggccatgccggctggatcgagctggaactggccgtcgacggcacctgcaccgtcagggacaacggccgcggcattcccgtcgacccccaccccaaatacccggacaagagcgcgctggaggtgatcctcaccacgctgcactcgggcggcaagttcggcggcgacgcctacaaggtgtcgggcggcctgcacggcgtcggcgtctcggtggtcaacgccctgtccgacgcgctgaccgtcgaggtggctcgcgaccgggtgctgtggagccagcgcttctcccgcgggctgccgctggggccgctggaaaaggtggggccggtgcagaaccggcgcggcaccaccgtcatcttccatcccgacgcccagatcttcggcgagcgcgcccagttgcgccccggcccgctctaccgcatggcgcggtccaaggcctatctgttccggggcgtgcagatccgctggaaatgcgatccgctgctgatcaaggacggcgacgagattccggccgaggacacgctgcactttcccggcggcctcaccgacttcctcaaggcggtactcaaggagcggccgctggtcaccaaggacatgttccaaggcaccgccccgcttgccgacgacatgggacaggtggaatgggcgctggcctggcccgacgatgacgaagaaggcttcgtcaacacctattgcaacaccgtgcccacccccgagggcggcacccacgaggccggcttccggaatctgctgaccaagggcctgcgctcctatggcgagatggccggcaacaagaaggccgggcagatcaccgccgaggacgtgatggtcggcgcctgcgtcatggtcagcctgttcatccgcgacccgcagttccagggccagaccaaggaaaagctggccagccccgaggccacccgtctggtggaaaacgcggtcaaggaccacttcgaccactggctgtcgggcgacaaggcctcggccggcgccctgctcacccgcctgatcgagaaggccgaggaccgggcacgccgccgtcaggccaaggaaatgaaccgcaagacgcccaccaagcgtctgcgcctgcccggcaagctggccgactgctcgcgctcggtcaatgtgggcaccgaactgttcctggtggagggcgattcggcgggcggttccgccaagtccggccgcaaccgcgagacccaggccattttgccgctgcgcggcaagatcctcaacgtcgcctcggcgtcgaccgacaagctgcgccagaaccaggagctgaaggacctgatggaggccctgggctgcggcgcgcgcgacaattacgacgacgagaagctgcgctacgagaagatcatcatcatgaccgacgccgacgtggacggcgcccacatcgcgtcgctgctgatgaccttcttctaccaggaaatgcccgagctgatccgcaacgggcacctgtacctcgcgctgccgccgctgtaccgcttggcccatggccagatcgtcgcctacggccgcgacgacgcccacaaggaagagctgctgaagaccctgttcgccaacaagaagaacgtggagatcagccgcttcaagggcctgggcgaaatgccccccgcccagctcaaggaaaccaccatggaccctagccggcgcaccctgctgcgggtcaccatcccctcgggccgcaccgaggaggatcatgaagaggccaaggatgtggcccgcctggtggaaagcctgatgggccgcaagcccgaactgcgcttcgccttcattcaggaacgggccaggttcgccaccgacctggatgtctgatcgccgcacccatctattgcgaggaaaagatcatggccgacgagaatttgagccccggcaacattgccaaggcgctgggcgtgtccgatggcaaggtgaagaaggccatcaaggatctggggctcgagcccgccgccaagcgcggcgtgtgcagcttctatgcccccgatcaggtggccaggatcaaggcggctgtgggggcctgaaccccgtggcacagcccacgcaggactggacccgcaccgtccccgatctggccgggctggaccagccgacccgcgaccggctgcgggcgctctgccgcccggccagccttcccgccggcacccgggtgttcggcgagggcagcccgtgtcaggcctacctgatcctgctgtcaggcgaggtccgggtgcagaaggtggcggaatcgggccgcgagatcgtcctttaccgcgtcgcggcgggcgagacctgcatcgtgaccaccgcctgcctgatgagcggggtggattacgatgccgagggcatcgccgaaagcgacgtcaccgcccagatcctgccggcctcggccttccgcgagttgctggggcgttcggaagccttccgcgacttcgtcttccgcgcctacggctcgcgcatttccagcctgctgatgctgatcgacgaggtggcgttcggccgcatggaccgccggcttgccgcctgcctgctggcgcgggccaagggcagcggttcggtcaccgccacccaccaggatcttgccgtggaactgggcagcgcccgcgaggtgatcagccgcctgctcaaggatttcgagcgacgaggctgggtcgccctgtcgcggggcagcctgaccctgaccaatcctgcggcgctggccgagaactaaattagcaaagtgtgtgactagatcaccgacaggccgccgctgccgctcctatgctcgggccatcttcggataaccgaaccagcacggagtggacatcatgaacaagaacgtcggcggcatcgaccgcatcctgcgcatcgtggtcggcctggtcctgatcggcctgaccctgacgggcatcatcggcctgtggggctggatcggcgtggtgccgctggccaccgccgccatcggctggtgcccggcctatctgcccttcggcatcaagacctgcaagatgaactgatccccgatttcccggcgccggtgactcccgtcaccggcgccggggcttctcagtcggtgatccggaaggtttcaccggcctcggtcagttccagcaggcgcttcaccccgccctggggcttggccaggctcatgaccgccccgaccccgtccaagtcttcccgggcgatgtagagcagccccagccccaccgaatcgatgtggctgaggcccgacaggtcgaacaccacctgctttgcctcgaccccgtccaggtcgcgcaacaggccggcgaagatgtcgttggcggcgaagttcagctgcccctgaagagcgacggtgacggcctgaccattcctggcgatgctgtattgcatgtccttcctcctcttgacgggaggggcggctattgccgcacccgcaccaggaagcgatcggtttcggcggtcagggcctcgaccacctgggtcaggctcttggcgctccagatcacccgcaccgttccggcgcaggtctgggccgaagagcgcgacagatcccccacattgctcgagacgttctgggcctgacgggccacctcgtcgatatcgtcggcgatctcgcgggtggcggcctcctgctcctgcaccgcgccggcgatggcggccgagatttcgtccagagttcggatgatgtcgacgatgctgccgatgctgtcggccatgccatgggacgagtcctggacctcgcccacctggcgcgagatttcctcggtggccctggcggtctggttggcgagattcttgacctcgcccgccaccacggcaaagcccttgccggcttcacccgcccgcgccgcctcgatggtggcgttgagcgccagcaggttggtctgggcggcgatgtcgctgatcagtctgaccacctcgccgatggactgcaccgattgggccagcccccccattcgattggcggtgatattgacgtcctccaccgtctggcgggcgatctcggtggacttggccacctggccggcgatctcgttgatggccagggccagttgccgggtcgcctcggcggcgccggtcgcccgctcggtggtgatgttcaccgcgtcgcccacgtccagcgagcgcgagccgctgcgttccgagcgccccgccatgacctgggcggtctggcggatgccgccggtggcgcgctcgacctcggcgaccttgctcttgacgctggcttcgaagtcgtcggccatggcccggatggcggcggccttttccgcctcggagcggaggcgctcggcctcgcgcacctcgcgcaggcggtcggcctcgaccatggcgtcgtggaagacctggacggcgcgggccatctcgcccacctcgtcgtggcggtcctgggcgggaatggccgccgccttgtcaccggcggccagggccttcatcacatcggcgatccgccggatgggccgctcgatggagcgccccagccacaggcccagggtcaggatcaggatgaagccgccgcccatcaccatctgctgggtccgctgggcggcgcccgccacctgggcagcccgggattcggcggccgtggcggcggattgggcgtcggccaccatggtctccagcaccccttccagccagtcgcggtggacggcgatcatctccttttccagggcgacgacctgatccaggccgtcggcggcggcgcggaaatcacggtgatagcgctccaggctctcggccagcgccccccgctccgccgccggcatccccgagaggggcagcgccttggcaaaggccgccaccagcgcgtccagctcggcccggtccgccgcctgtcggcgcagcaggaagttcttttccgtgcgccgcatctgtaggaccaggatggtaaggctgggctcgtcgccggccgtcagcaccttttccatgtccagggcggaattgcgcaaggcccccagcaggccgacctgatcggtgaagcccaccttgcgctgggtctccaccagggagacgaaggcacggctatagcgctcggccccgtccttgaccttggcgatcaactcgcgccggggcggcccgtcgccgggcagcacggcggccatccggtccagggcctcgcgggccgcggccacgtggcgcggctgcttggcggcggaatcctcgtcacggcgcagcaggaagtttttttcctgacggcgcgcctgcagcagggcgatgtccaccttatcggtcagagccatcacggcgcgaaacccctcggcttcgctacgggcggattcctcgcgcagatggctgtcccacagcagcagggccgccgcgagaaacaccagaccagcgatgatggtaagggaagcgacctggcgccggagcggccaccgcgagagaaggcgttccatcctgcccctcctgccggcccagcggccgacctatccttaagattaggccatcatatccctatggcgtataccgctcaaccattcaatgcaggcgttcacatgggcaacggcaccagccggcggcgcaaatgacgattccggactgcgaattgtcaatgcgccgccccctcccggcgcgtagcctgggaaggcttctcatgcgggaaggccgggggcagatcccctgtccacaagcgcctccggccctttcccgcctgatcggcgacgccgcgttcccggtggcgtcatgacagccttgccctcccttggcgtcataccgacaaggccgccgcacgctccccgtcggcggccttgttcgttttataaaaattccagacccaccctgcgaattgtcaatgcggcccaaggccgccaccgcctaggctcggcgggctaaccacagcgaaagagccccctcatgtccatgctcggcaagacgcctcagccgtcccctgcctgttccgcgacaccggcctacgccgcctcggccaagatccacccccgaggcgtgaaggggcgttaccgcagcttcaagtggtgggccagcgtcctgctgctggcctattggcatctggcgccgctgatccgctgggatcgcggccccggggcgcccagccaggccatcctggccgacatggcgggacggcgcggctatttcttcttcatcgagatctggccgcaggaagtctacttcctgaccggcctgctgttcttcgccgccatcgccctgttcctgatgacctcgctggtggggcgcgtctggtgcgggttcctgtgctggcagacggtctataccgatctgttcgtggcggtggagcggctggtgatcggcgagcgcaaccagcgcatcgccttcgaccgcgcccccctgtcggcgggcaagctggcgaaaaaggccctggtcaacgtcatctggctggccatcgcggcggcctgcggcatcggcttcacgctctatttcggcgacgccttcgagatgctgcgcgacatcttcaccggtcaggccagcaccgcgacctatggcgccatcgccgtggtggggggactgtgcttcctgctggccggctatgcccgcgagcaggtgtgcatctatatgtgcccctatgcccgcttccagtcggccatgttcgacgagcattcgctgatcatttcctacgaggcctggcggggcgaggcccgcggcccggccccggccaaccgcgacttcaccggacgcggccattgcgtcgactgcctggcctgcgtccaggcctgccccaccggcatcgacatccgcaacggcaatcagctggcgtgcatcggctgcggtctgtgcatcgacgcctgcaatcaggtgatggaccgcttcaagctgccccacggcctggtgtcctatgattcctcggccaatctggcggcgcgcggcgagggtcgcagcggcgggctgcgcctgatccggccgcggaccctggcctatggcgccatcctggccctggtggcctcggtcatgctgttccgcctgaccacgcgtcccgacgtggacgtcaacgtgctgcacgagcgagcgccgctgttcgtgcagatgtcggacggctccatccgcaacggctatgtctacaagatcctcaacatgaagtccgaggaccggaccttcaagctgcgcctggccggcatcgagggcgccaccatcacggtggtgggtggcgaggattccgtggccgaggccgaaatgcaggtcccccgcgattccgtgggctcgttccgcctctacgtcaccattcccgccgacaaggtggtgtccaagagcatgccggtcagcttccagctcaccggacccggccgccaggtcaagacggaaaccctgttcgccggacccgaccggtaagcggagtcagccctcgccggcgatgccgtcgagggcggcgagatcgcgctggaacaggttcggcgcgatctcggtgaccacgcccaggcgcttgaattccgccaccacccggctggcggtttcgggcgtgatgcccagcagcgcccccaggtcctcccgcccgaacaggcggcaatcgggggaggtctcgggggccagcagccggaacagccgggccacccgctgccgggcgctgccggtggacaattcgcgggtgcattcgtgggagcgctggacggcgtcgtgccacttcttcattagctggcggtgcagcttgggcgacaggcgggtcagcacctcgcgggggatgcggcagaccttggcgggcgacagggcgaccgccgcgtgctcgtaggcatcggccaccgtggcctccagcccggccacgtcgccctggcccagcaggctgacgatgcggtggctgccgtcggggagatactgttccagcttgaacagcccctcgcgcacggtaaaggcgtgcccagcctcctgccccggctggtagagggcggccccggccggcaggcggatatcctcgatgggcaggtggatgacgccgaaatcctcacccttgaggtcggcgaacagcaccaggtcgcggatagagcattgctcgcacgaggccagcccgcgccaggccgcctcgatctcgtggtcacgcatgggatacccggccgcttttccgagaagggcggcaaggataacccgcggaaaggccggggaggaataggcgatgtgactcgccctacgcctttcccccggccagccgggccacacccagcaatccggcgacgaagccagccacgaagaccagcgccaccggatggtgcagggaaaccgccaaagcgggcgccggacacaacccggccagtccccagccggccccgaaaacggtggaaccgatcagcagccgggcgtcgatccgcgtgggcggcggcgcgggaatctcggcccccgccagggtccggccgcggcggcgcagcagccactggcccagaaacgccatggcgacggcgccgcccatggtggcggtcaggcgcgggtcccaatgaccgaagaaatcgaggaagcccaccaccttggcgggatcggtcatccccgacagggccaggccggcgccgaacaccacgccgatcagcaggaagacaagggcgcggctcatggattgggtactcccaccagggcgaccatgacggcgcccaccgcaatgaacaggaccgtcgccaccagagaacggggcgacaggcgagcgatgccgcagaccgagtggccgctggtgcagccattggccagcccggcccccacgcccaccagcagaccggccagggcgaggcgccccggcgaggcgaaggcgacggctgcgccgcccccggccacgacctgaaccagcagggcgcccagcggcagcccgatcacgaaggcgacggcctccagccggccgcccagggcattgcgcaccaggccgctgaccccggccacccggccgtaggtcagcatcagcccggccgccgccagcccgatcagcagcccgcccgccagggcaagcccccaatccatgggcgacagcgtcaccatcactcggcggcctgcttcttggccgcgaactggtcataggcctcgagcgccagggcgccgtacatcagcgacggcccgccgcccatgtagaccgacatggcgatggtctccatcacctcgtcgcgggtgccgccaagatccaccaccgccttggcgtggaaggcgagacagccgtcgcagcgcgctgcgatgcccagcgccagggcgatcagttccttggtcttgccgtccagcgccccatcggcggtcgccgccttggccatggcggaaaagcccttcatcacttcgggcaccccaccgcgcacctgtcccaccatcttggacagcccgttggccaattcgttccaatccttgagcatcacgcacctcgtccttggaatcatcacaatatgttagatgactctaatatataggggtggcggcaggattcaagggccgagcgcaggactcgcccccggcggccgcatggcggcatgcgtggatcggatggctggccttggctcttggagcaagctgtggcgaaaccccgcttgcgtggcagggctaccaccctggcccgttcggaggcaccagcttttcaagaaactaaagggttcgggaagctgggcttcccgattgggggatcgggggcaaacgcccccgaaggggagccttttcgcagcctgttaatgcccggaaggacgggccggcggacgggcggcgggcggcggagcgctggggagcgggcggcgggcgggaccttcgtcggcatcctcgtcggagaccttctggcggaccacgaagccctgcagcgcccagccgaccacatagaatgtccccaccgagaaccacaggcccgacagggcgaagatcaccgcgcgatgcagggcgtcgtcgccggtcccgaaggtgcccaaggcccacagcatgggcgagatgaacaatatgcccaccgcgcccgccagtcccaggcgggtccagccggtggagcggatataggaaatcctgtagctcgacatcttcttcgatcctcccccgcccattccccatggggttctggccggattctggacgttcgcggcgcgaaccgcaacccgccttatgtgtatgcctatccgtgattatccgaataaccccgtgacatagtgtgtcggcagcggctatttttcagtatccatccgagactgaatgtctggtcggtgggcatgaatacacgtggcgggcgaggaccagaatggtctccagtcgggaaaactttgaagttcaggtcagcaagggcggccgttgggcgacggaaactgtcgttccaaaggaggtagaggcgcgagcgctcgccaagaaattcctggccgacaagaagtgcgagggtgcgcgcatcgtgcgcaactggatgcgctcggacggcaccatggacgagaccgagatcttcgcccagacccgttcggtcaatgacgacggcccggtccgcatcgcccagatcgacgaggtcccggaaaagtgcgagacccccgacgagttcctggggaattccggccgcagcgtggtcaaccgcatcttccgcagctatctcgacaaggcgatcctgacgcccaccgagctgatgcacaattacaaggagctgaagcggctccaggaaaaggacaccctggtgccgtcggccgtggatcgggtgtcccagttgcagaccaaggattccgaccaggattccaagtcgcgcagccaggagatcttcaagtccatcgacgacatctcggcccgcgccaggcgggtggagaaccttcagttgcccaagctggacggccggttctccgacgccatccgggagatcaggggcaaggcggccggcgaggacgtcgactatctggccatggtgctgctgtcgcgcgacctgatcaacgcccgctcctgggtcggcaagctcgaattcctgtgcaagctggcggtcgaggattccgacccccatgccgtcgaactgctggacggcgttatcgccgatgtgctgggctcggcggtggtgcaggaaatcctcggctggcagcccggcctgggcgccgccatctgccgcatgttcgacctggccgacggcaagtttcccaccgagaagagcgaggccggcgaatccgccgttatcctcaaccgcctgttcggcgaggccaagctgcccatcagccgcgcctgcctgctggaccgcgcccaccgccagatcaagtcgcccaacccgctctaccgcagccaggaaggcaaggagctggaggagttgaagaagctggtggaccgtgccatgacgcccaccggcttcatctcgggacccgagaccgccgaggccctgaccatccgctattcccgccagatcgagcagggcggcgcggcgggccgcaaggccacggtcaatggcctgttccgcatgctgcccgaccgcgccctggggctgatctatatctgcaacctggccgccaccccctggggcggcgacgccatcgccgatatcgccgagttggtggattactgcctgtcggcccgccatctgggcgatttctgcctgcgctccctgccacccaaggacaagatgctgcgtgccaccctggcgcacaagaccgccgccgccaccaccgccctgccgccggcggtgcgtgaaaagatctgcggcttcatcgacaccatgctggaggcctatctggtcaccgagcagatcgtcgagaagctggaccaccaggattcccacctgcgcgaccgcgccgtgcgcctcgtccagttctgcgccgccggcgtgctgcccgagggcaaggccatgaaccgcgcccgccagcgcatcctggccctgctgcgccagcccaatttcgacgcccattttatcgacggcttcaccgacgccgagcgggcgcaaaaggccctgcgcgacttccacgtcctgctggtcaaggccggattcggggggtagcgggctccgctcaatcctcttccggatgggaatgcggcccgcgcagcggcttggcgcaatgggggcaaaggtgccccgtttccaccgactggcgcaggatcagcgacgcttcttcctcggagagctgcaggctgcgccgcgtgcggtccagcaggcgacgttccgagcggttgatggagccgtcctccagcgccttttccaccgcctcgcggtattcctcgcggcggatgcgcatctgctcggaaaagcccgaggccagaacaccggccggcaaggcgatcatgcccacgcccagaatagcggtcagcgcgcccagcatccgccccagcggcgtgaccggcaccatgtcgccatagcccaaggtggtcagcgtcaccaccgcccaccacatggaggtgggaatatcgctgaacacatggggctgggcccggtgctcgaacaggtagatcaggctcgacgtcagcaccaggatcaccatcatgacgaacagcaccgagccgatggaacgcgcttcctggcgcgccaccgccgccatgacgttcatggccatggaatagcggcccagcttgaagacccgcagcacgcgcagcacgcggatggcccgcaggtccagctcgaccacgatgcccaggaagaacggcagcaccgccagcaggtcgacgatggccatgggcgacaccgcccagcgcagccgcccccagaccggatggcggaacttgggatcgtccagctccaccgccgtccacaggcgcagcacgtattccaggctgaagatggccaccgaggtcaggtcgaaggcgtgaaacaccggcccatgggcgatggacaggtgctcgatggattccagcaccaccgccgccacgttcaagacgatcagggcgatgaggaaggcgtccaccatcttgaccagcaggtcggaatggccgtcgccgcccagcatgtggtagaccgtgcgccgcaaggtccgccgccgccgcacatgccggtggcccggatgcggatgccccggatgcgggtgggatggttgcggcggagcggaatggcttggggtcacaaaacggccgatgtcaaagacgtcaatttgcgccaccatatccgaccgcccccggtgaggggaaggggcggacgatggccgggttggccggtgacggaatttcgtggcgcccagggcgcccattactttagtgtaagataatataaagagcgggagaggccatgagcaaggccacgtctgataccaaggcagggcgggtttttctgatcggggcggggccgggcgaccccgacctgctgaccgtcaaggcactgcgcctgatccagggcgccggcctagtggtctatgaccgactggtcagtaaggaaatcatggacctgatcccggccgccgccgagcgcctctatgccggcaaggcgctgggtaaccaccatctggtccaggacgagatcaacgagctgttgctgcgtctggcgcaatcgggccgcgatgtggtgcgtctcaagggtggcgatcccttcgtcttcggacgcggcagcgaggaagccctgtatctggcccgccacggcatcggcttcgaggtggtgccgggcatcagcgccgccgccggctgttccacctatgccggcattccgctgacccatcgcgggctggccaccggcgtgcgcttcgtcaccggccatctgcgcgaggaccgctcgctcgacctggactgggccaagctggccgacccggacatcaccctggcggtctatatgggtctgcaggccctgcccgagatcgccgggcggctgatggccgctggcctgcccgccgacacccctgcggcggcggtggaaagcggcaccacgccgcgccagcgccgggtggtgggaaccctggacaccctgctgggcctgacccgcgaggccggattgcaggcccccaccctgctgatcatcggcaaggtggttgggctggccgacgaattggactggttcggcaagccgtgaccccccaatcctccgccctggtgctggtgggacatggctcgggcaactaccccgatgccgccaggcccatcctggccctggcggagtccatccgggccagagggctgttcgccgaggtgacggcggtgttcatgaagcaggacccgccgctcgcggccgccctgtccctggtccaatccaagaccgtgtacgtggttccggtcttcgccgggcggggctattacaccggcaccctgatcccgcgcgaaattggactgaccggtcaggtaaccctgcgcgatgaccgccgggtgatctacaccgagccggccggcacccatccccgcctgcccggcctgctggcctgccgtgccgatggcgtggcgcggtcctgcggctgggcgccgggcgggaccagcctgctgctgatcgcccatggctcggcacggccgggcggcgcgggcgagacgccccgcgccatcgccgcggccttggccgccatgaatcacttcgccgaggtggagctggtcttcctggagcaggagcccctcgcccgccactggcccgatctgatcaagggccggcaggtggtggccctgccgctgctggtggcgcaaggcctgcacgccggccgcgacatcccgccgctgttcagcctctcccagggcgagaccggcccggtggcaagccacggccgccaagtcgccctggccaccggcctgggcgccgagccggaactggaggaaatcatcctcgatctggtccggggcacggcctgacaggtcccattcccctaccccacggggatcaaagggcctcgggccctttgcgggcgtgggcggagcccacagctatttcgcgccccactcccccatcaccgccatcatctcagccaccgtcttctcatcgagatcgacgatggtgaagcgggcgcggccttccttgatgcgcatccgcaggattctcaggccgctttcgtgatccacggcggaaaagctgatctcgcgactccagggggccgccagggtggcgaggtgagtcacgtcttccttggcgaattggggatcgtcggtggtcatgaaatcctctcgtgatagcgggcacgatacagcaggcgtggactggcgggatcgtccttgaagggttcgcgggtgtgcaacggattgttggagaccagcccctggccgggctccaacacatgctcgaagatgtggggcgacggcccgtccagcaggcgccggatggccgccgccgccggggcggccgcctcggaccacaccacgttgcgcgaccgcgccgtatagcgcatgtgcaggcttccgtcggcattgaccgagaacaccggccccacggtggccgggcgggtcagcccttcctcgtcattgccgggaatggtcatggcgtcgggctgcatcagtacccggatcagctccgggtcctgatcgcgcagcagaatatagagcatctcgtggtccatcagccggttggcgccgccttcggccgccttgccggcgcaatggagcagcagggcgcgcacaatgcgctccggcggattgtaatagccgtcggtgtgccaggtgatgggccgctcggtgtaagggatatagcgggcgcgctggccctcgcggtgcacggccaggggcgtgatgccatcgtcgtcggccagggcattggcatccagcgtcgccagccccagccgggcgcccagggatttcagcgccgccttgtcgtcgcgacccggcttgggccgctcggcgtagaccgccatgttgcaacggccgagccggtcgcgcagcgccgccaattcggccccactcagcgcggcgatgtcgcccacttcgacgaccaggtcacccacgtcccgaggggcgcgggccagcctggactcgcgccagcgcccatatgcgtcccgatcatccaggcgaaaatagcttggaatcattggaatttttcctcccccgccattttcatgcgaattcgctaaagaatccacttggatcgacgctgtccataatattatcatcctcgaatgtaacgagccgcatagaacggccggacaatcaggagaggtccgggagcaaagcttcccaacggatcaaaaagttgacccagcgtattgccgcgccgttttggcgcgcgtgcgaacgcgtagtgacgacggtgagggagcgaaacaacaatgtcgaagaagatgccgccgacccccatgctcgaccagctggaaagcggtccctggcccagcttcgtgacgggcctgaagcgtctggccgaggacggggacaagcccagcgccaagatcatgaagggcctgctgggccagctggagcacagctaccagacccgcaagggctattggaagggcggcacggtgggcgtgttcggctatggcgccggcgtcatcgcccgcttttccgagcaggcggcccagttccccgaatcctcggaattccacacgctgcgcatcatgccggcgccgggtttcttctatgacaccaagacgctgcgccagatgtgcgacatctgggaggagcacggctcgggcctgatcgccctgcacggccaatcgggcgacatcatgttccagggctgccgcaccgagcaggtgcagcccgcctgggacaagctgaacgagatgggcttcgacatgggcggcgccggcgccggcgtgcgcaccgccgcctcctgcgtcggcccggcccggtgcgagcaggcctgctacgacaccctggccgcccatcgcgccatcatcaacgacttcaccgacgacattcaccgtccctcgctgccctacaagatgaagttcaagttctcgggctgcgccaatgactgcgccaacgccacccagcgcgccgacgtcgccatcctgggcacctggaaggacgacatgcaggtcgaccaggacgaggtgaaggccaaggtcaagcaattgggccgcaaggaattcatcaaccaggtgatccgcatgtgcccaacccaggccttagggttgaacgacgacgacaccctggacgtggacaacaagtcctgcgtgcgctgcatgcactgcatcaacgtctgcaccaaggcgctcaagcccggcaaggagcggggcatctgcatcctggtgggcggcaagcgcacgctgaagatcggcgacctgatgggcaccgtcctggtccccttcatgaagctggagaccgaggaggatttcgctggtctggtggagctggcccacaacatgctcgatttcttcgccgacaacgcgctggagcacgagcgcaccggcgagatgatcgagcgtatcggcctggtcaattacctggaaggcctgggtctcgaactcgacgtcaacatgatcaaccagccgcgcaccaactcctacatccgcaccgacggatgggacgaggaggcccgcaagtgggccgagcgcaagaattcggccgccgagtaggagaccaaggatatgagcgaacttcgtcgtcccgtcgaatgcggcgtcccggattccaagcagttcatgcatccggccctggtccgcaattacggccagtgggccttccacgaccgtccccgccccggcgtgctgcgccacgtctcggactcgggcgaggcggtgtacaccgtcaaggccggcacccagcgccagatggacgtccacaccatccgcgccctgtgcgacatcgccgacaccttctgtgacggccatgtgcgcttcaccgtgcgctcctcggtggaattcatgaccaccgacgaggccaaggtggccccgctgatcgagcgtctggaaaaggacggctttccggtgggcggcaccggcaattcggtgggcttcatcagccatacccagggctggctgcactgcgacatccccggcaccgacgcctcgggcgtggtcaaggcgctgatggacgaactcgtcgacgagttcaagtccgaggagatgcccaaccgcgtcaagatcaccacctcgtgctgtcagatcaattgcggcggccagggcgatatcgccatcaacgtccagcacaccaagccgccggtgatcaaccacgctttggtggccggcgtctgcgaacgcccggcggtcatcgcgcgctgcccggtggcggccatccgtcccgccctggtggacggcaagccgtcgctggaagtggacgagaagaagtgcgtgtgctgcggcgcctgctatccgccctgcccgcccatgcagatcaacgacccggtccattccaagatcgccatctgggtgggcggcaagcactcctccacccgttccaagcccatgttccacaagctggtagcggcgggcctgcccaacaatgcgccccgctggccggaagtggccgaggtggtgaagaagatcctagccgtctacaaggccgatgcccgcgcctgggagcgcatgggcgagtggatcgagcgcatcggctggccccgcttcttcgagctgaccgagctgccgttcaccaagtaccacgtggacaactggcgcggcggccgggccaatctcaacgcctcggcgcacctgcacttctaggagaaatgagcgatgaaattcgccattctggtcaatgaaggcccctataaccatcaggccgccgacagcgccttccagttctgcaaggcggccatcgacaaggggcacgagatcttccgcgtgttcttctattacgacggcgtcaacaacgcgaccagcctgggccagccgcccagcgacgaccgcaacgtgaccaagaactggcagaagctggccgaggagaacaaggtcgatctggtggtctgcgtcgccgccggcctgcgccgcggcatcaccgaatccaaccttgcccagggcttccgcatctcgggcctgggccagttgatcgaggccggcatccatgccgaccgtctcgtgacttttggggattaaagccatggacgatatggaaagcggcgtcgtcaaaaagttcatgttcgtcaaccgcaagcccccccacggcaccgtctacgccctggaagtgctggaaatggtgctgatctcggcggccttcgaccaggatgtgcatctggccttcctcgacgacggcgtgctgcagatcaagaagggccagacccccgccggcatcggcgtcaagaacttctcgcccacctaccgggcgctggagggctacgacatcgagaagctgtacgtggaggccgaaagcctggccgagcgcggcctcaccgaggacgacctgctggtcgacgtggaagtcatcagccgggccgacatgggcaagctgatggccgagatggatgtggttctgaccgcgtaactccgaggggcgcaagccccgaggcaagggcaaggcccgccgcgccttatggcgcgagagccaagggtttcgcgagaaacccgcccggcgattgagggacaagaggaatcgaacaatgagcatactgcacaccgtcaacaaatcccccttcgagcggtcctgcctggatgcctgcctgggacacgcccagccgggcgattccgtcctgctgatggaggacgcggtgatcgccgcgctgtccggcaccgcgttcgagggtaagatggccgatgctgccaagaccctgaagctgaacgtgctgggtcccgacctggcggcccgcgggctggaccccgcccgggtggtgtccggcatcagcgtcgtggattacgccggattcgtcgatctggcggctgagaccaaggcgaccaacgcctggctgtaacttcagtacgcatcaagaagaagcaaggagaggaacacatggcttacaccagcaacggcgccaccatcgaggctgatgaagagggctatctgaccgacatcaaccagtggaacgaggacctcgccgggcagatcgccaaggacgagggcatcaccatgagccccgagcactgggaagtggtcaacttcctgcgcgaatactatgccgagtaccagatcgctccggcggtgcgcgtgctgaccaaggccatcgccaagaagatgggccccgacaagggcaacaacaagtatctctacgagctgttcccctacggccccggcaagcaggcctgcaagatcgccggcctgcccaagcccaccggctgcgtgtaatcaccagcctgtcatcctgagggagccctgcgaccgaaggatctcatcctggaagggctcggccgatccggcaccgcccttccagacggagatccttcgcttcgctcaggatgacagcctgattttggtgcctccgggtgaacgagggaaccttgacgatctttttcgccattctcttcagcgtctcgaccctggtcttcgcggccgggctggccatgaagatcgcccagtacgcccgcacgccggcgccgttgaagattcccaccacgccggcgcccctgaccaagggcggcgtggcgttgcgcctgggccgcgaggccctgctgttcgaaagcctgtttcgcggcaacaagcccctgtggctgttcgcttttgtcttccacctgggtctcgccgtggtcctgatccgccacgcccggtatttcgagacccaagtggggccgctggtcgccctggtccagcccctggcccaaccggccggtctggccatggtggccggtctggccctgctgctggtccggcgcctggtggtcgagcgggtgcgctatgtcaccggcccctcggacatcctgatgctggtgctgctgctgggcatcggggtgagcggcatgctgatgaagtgcgtggtccatacggacatcgtcgcggtgaaggccttcttcaccggcctgatggggttcgagctgcgccccctgcccgccgatccgctgctgggccttcaccttctgctggtctgcctgctgatgatcatcttcccgttctccaagctgctgcatgcgccgggcctgttcttcagcccgacccgcaaccagaccgacaatccgcgcgaggtgcgccatctggccccctgggccgccaggctggaagagaagggctgaagacatggctgccgctcccttcgacatccccgccctgggcgacccggccgagcatccgattccggccttgaagccgggcgccatggccgcctccaagccctatgtggccgccgaggcgcaccagcagcccctgggctttcccggcgagttgaccgagggctgggaaaagcgcgccgtcgagcatatgggctcgctggtgtccaagtaccgctcgctgcaggtctacatggacatctgcgtcaaatgcggcgcctgcaccgacaagtgtcattatttcctggggacccacgaccccaagaatatgccggtggcccgcgccgacctgttccgcagcgtctaccgccgctacttcacgccggcgggcaagatcgcccccggtctggtgggcgcgcgggacatgaccaaggacgtgctggacgagtggttcaactacttccaccagtgttcccagtgccgccgctgctcggtgttctgcccctacggcatcgacaccgccgagatttccatggcggcccgcgacatcatggattccatcggccagggccagaagtactgcaacgagatcatcggcaaggtccacaagatcggcaacaatctcggcctgcccgccccggccctgctcgacaccctggagggtctcgaggaggacatgctggacgataccggcgtggcggtgaagatgcccatcgacgtggaaggggccgaggtgctcctcgtcaccccctcggcggatttcttcgccgagccgcacgtcctgggcctgatgggctatgccaaggtcttccatgccgccggcgtgtcgtggaccctgtccaccaaggcctcggaagccggcaatttcggcatgttcatcggcaattacgaccagatgaagaagatttccatgcgcatccgcgaggcggcgcaggaactgggcgtcaagcgcatcatcttcggcgaatgcggccatgcctggcgcgtcgcctactccttcctcaacaccctggcggggccttgggacttcctcgatccccgctatccggtgccccagcatatcctggaattcacaaacgacctgatcgagcgcaagggcatcaagctcgacaagtcgggcaatgacggcatggttctcaccgtccacgattcctgcaacgtggcacggggtgcgcgcatgggcgaccggccgggcggccagttcaccatcccgcgcgccgtgatccaggccagcgtccccaaattcgtcgacatgcatcccgacaccatctgcgacaagaccttctgttgcggcggcggcggcggattgctgaccgacgagctgatggaactgcgcgtcaagggcgccagcccccgcatggaagccttgaaggacgtggtggacaagcagggcgtcacccacatggccgccatgtgcgccatctgcaaggcgcagttcaccaagatcctgccctattacgacttcgaccgggaaatggtggtcagcgttcaccaactggtgagcaacgccatcatcctgggcgacaacgactaaaagtattccgaggggcgacaacgccccgaggcaagggcaaagcccgccgcggcttatgccgcgaaagccaagggatgggaaccagcccgcccggcgactgagggactagaaacgagagggagagcacgcatggccgccaagaccagcgccgagaccaccaccgaggggcggaacttccgccgctaccaggacggcgatttcacgcccaagcactggcaggaagagatcttcaaggccggctggtcgcataaatgcccgacctatgtgctgcgcacgccgccctgctcgggctcgtgcccctcgggccacgacatccgcggctggctggacatcgtgcgcggcgtggaaaagcccccggccggcatggcctggcaggaatacgccttccgccgcatggtggaggccaatcccttccccgccgtcatgggccgcgtctgcccggcaccgtgcgaaagcggctgcaaccgcaacatggtcgaggagcatgtgggcatcaattcggtcgagcaccatatcggtgactgggccatcgccaacaagctgaccttccccaagcccgagcatgagacgggcaagcatgtggcggtggtgggcggcggcccggccggcctgtcggcggcctatcagctgcgccgccagggccatgccgtcaccctgttcgaggaaaaggccgagctgggcggctatgtgcgctacggcatccccggctaccgcacgccgcgcgaggtgctggattccgaaatcggccgcatcatcgatatgggcatcacggtgcgcacccagtgccgcatcggcaccgacatcaccgtctcggaactggaagagaagtacgacgccatcttctggggcatcggcacccatgcgggccgcggcctgcccattcccggctggaaggacaccgtcaactgcgtgtcgggcgtcgccttcctcaaggccttcaacgagggccggctgcagcacgttcccgggcgcatcatcgtggtgggcggcggcgacacctccatcgacgtggcctcggtggcgcgccgcctgggccatatcgacacggtgtccgagcaggaccgcgccgacaacgtcatcctgggccatgtggcccacgacgtggcggccacggcgcggcgcgagggtgccaacgtcaccctgacctcgctgttcccggtggagaagatgttcgccgcccagcgcgagatcgacgacgccaagcgtgaaggcgtggacatccggggcggcatcatgccgctggaggtgatcctgggcgccgacggccgcgccaccggcctcaagctctgccagtgcaccatggagggcatgattcccaagcccgtcgaagggaccgagttcgtcctggacgccgatctggtggtctcggccatcggccagagcggcgatctggccgacctgcccgagatggacaacggcaagggcttcatcaacgccgacaaggcctatcgcgtgccgggcaagcccaagcacttcgtgggcggcgacgtggtcaagccgcatctgctgaccaccgccatcggccacggccgcgtggcttcggccggcattgccgaattcctcgaccacggcgacgtggccaagcgccccaaggtggacgtgcaccacttcaacctgctggccaagctgcacgaaagcaacctggacccggcgccctaccagcccggcccggtgcgcggcaccttcgaggccaaattcgccgtgcacaatttcgagaaccgctcggcggagcagatcatcccccatgacgacctgttcctggggcatttcacccgcacggcgcgtcaccatcgccacgaagtgcacatcgacgccgacaaggtcatcggcaatttcgacgagcgcctgctgactctcacggatcaggaggtcatcgacgaagccaagcgctgcatgtcctgcggcctgtgcttcgagtgcgacaattgcgtggtgttctgcccccagacggcggtcagccgcgtcaagaagagcgagcgcaccacggggcgctatgtggaaaccgattacgccaagtgcatcggctgccatatctgcaaggatgtctgccccaccggctatatccagatggggttgggggaatagggatgctggcaaggctgctcctgggagtactgatgatgctgggagcggcggcggccacggccgccgatctgccggccctgcccaaggccaagggcgaggcctgcatcgcctcggccgaggtgatgcgccgcgaccaccccgacatgctgaagcatcagcgggacgagacgctgcgcctcggcatccggggcgccaaggcgtcgctgaaggaatgcgtggcctgccacgccacccaggccgccgacggccacgcggtgccggtcaacgatcccggccagttctgccagtcctgccacgcctatgcggcggtgaagcccgattgcttcgagtgccacgcgacgacacctaaaaccaccatcaaggaggcgtcgcgatgatcaatcgccgtcacctgctgctggcctccggcgccatcctcatcgccgcccccgccgccgcccgcgaggcgggaaagcctgccaccgccgcccagcgctggggcctgctgatcgacaccggcaagtgcggcgccgaatgcacaatctgcgtcgaggcctgcaaggccgagatgggcctcgccggccacgaccggccgcgcaccgacgcccaatacatccgcaaggtcaacgtcaaggaccccgccaccggcgccggccattcggtgccggtgatgtgccagcactgcgccaagccggcctgcgtcgacgtctgccccaccggcgcttccatgaagcgggccgacggcatcgtgctggtggatcgccacatctgcatcggctgccgctactgcatgatggcatgcccctacaaggcgcgaagcttcgcccacgaggaacagaccggccagcagccccatctgccgcggggcaagggcacggtggagggctgcacactgtgcgtccaccgcatcgacgagggccggcttcccgcctgcgccgaggcctgcgccgccaaggccaagggcgccatgctgttcggtgacctcaacgacccgaaatcggagatcgcccagcgggtggcccgcgaggccaccacccgcatccgcgccgatctggggctggagcccgccatgcgttaccaggggatctgagccatgagcagcaccaccacctacactcaagtgcgcccctacacccggggctggctggccctgatggcggccctgggcgccgtgatcgccgtggcgctgggcgccgtcttccacatggagcaccagggccactgggtcaccggcatgaccaaccaggtggtgtggggcctgccccacgtcttcgccgtgttcctgatcgtcgccgcctcgggggcgctgaacgtcgcctccatcggctcggtgttcggacgccaggaatatcagcccctgggccggctgtcgtccctgctggccgtggccctgctggccgggggactggcggtgctggtcctcgacctgggacggcccgaccggctgttcgtggccatgacccacttcaacttcaagtccatcttcgcctggaacgtcatcctctattccggcttcatggccgtggtggcggtctatctgtggaccatgatggactggaccaggaagcgcttctacaagccggcggccctggccgccttcggctggcgcctgatcctgaccaccggcaccggctgcatcttcggtttcctggcggcgcgagaggcctatggcgcggcggtgatggcgcccctgttcatcgccatgtccttcgcctatggcctggcggtgttcatcctggtcctgtcggtgtcgttcaagatgacccggcggcccctgggcgacgaggtttccacccggctgctgcggctgctggggctgttcgtggcggcgaatctctatttcaccgcgctgttgcacgtcacccagctctatttcgccggacgaagcggcgtggaatccttcatcctgctgcagggcggcctccacaccaccctgttctgggtcgggcaggtgggattgggcggcatcctgcccctggtcatcgcctatggcggctgcggccatgccccgcgcaagcgggccatgatggcctccatcctggtggtgctgggcgggctggcccaggtctgggtgatcatcatcggcggccaggcctggccgctggacctgttccccggcatggaggcgtcgtccaccttcgccgacggccatgtccacgactatgcccccagcgcctgggagaccatgctgggcctaggcggcgttgccatcgccctggtgatcaccaccctgggcgtgacggccctgcgcctgctgccggccgggctgggagagacaaccagttcgtgcgccggtcataagtaggactcctatgccgcacacagactgaagtatgtatttattaacaaattgttgctgtttgtgctaaaaatcttccaaactaacctttgggataagggcaggtaggtatcacttcccgggggggacagtgtgagcgcaagcagcaaagcccgtagagggccggaaacgtcgccgcaggatgatggactggacgccgtgcgcaatacgttgcgcacgcaggtctcggagattcttcgcgtcaatctcactcagctttccgccattccccagcatctggtctatgaccacatcctggacacgcccgacctgttgcacgaatgctttcaggtcttccgcaatcagcccgacctgttccgcaaggtggtgctccgcaaggacaagcgtcccgccaccgaaggcgacgaggagctgtggtgcggccggaccctggatcacgtggtggcgctggtggtgcgggcctcggccaagcgctatttccgcgaggccatgcccgcccccaccccgccgcccgtggtggtcgaggccccgtcgctgctgcacaagaccgccatcaagctgggcatcaagaagcccgcccaccgcgcgccctacgtgacgccgcaggggccgggcgacaagctctacaacatgttccgcgacaatctgcgtttcgaatggcaggttccgctgatccccagctattcggcgctgacccccagcatcgtccgagtcctggggccacgcatcctcaagctgcgcgaggccacccagatcgacatcctggccgccgaggggcttggccccgacgggcgcctgccgctgctgctggaagatgcccgccgcctgcgggccgtggatggcagcatcgattccaacgcgctgatggaggccttcaccaagcagggcctgaacgccatcttccccgacctggacgacgtggccctgcgcaaggcggtgtcccagatcgccgtgatggaaaacaaggcggtggacatgatcttccccgccctggaatacgccctgaagccggtgacggtgttcctgttcaccgcctacgccaagctggacatcaagggcttccgccaggccttcggtcctcactgtgccctgtgggcggtgcagaagctggccaagcacctggaaacccagcgtccctggccgcggtccatgccgggcatgaagtcggccagcatcgccgccatggcctatgccatcgacctggacagcggcatgccggccagtgcgccggtccgtcaggcgccgcaagcggtgaccggcgtgcccagcaatgccgccgtcccctccatggcctcggcggcgccgccgctgccgccctcgctgaagaaggcgccggcggcgaagtccaacgccgatctggagcgggcgtcccgccgggccaagcctctggccagcgccggcgcgcggtaagatcttcccgtcgtcccttggcctgcgccggggatgacggcctggggcagtagccccgacccggattggagaccatgtctccaaacctctcttttgcttattcataaaatcaaagggggaccgtggcatcgcgccccgggcgggcgcgggcaacagcccgccaggcggcggatcggacgtaactggccgcccgaccctacccccgcagcgcgtggatttccgacacggtggcccgcagccgtccggccagattgagggccacggtctccaccagccggaaggccatggcggggtgatcctcgcccagggccaggaagccgtcgcggcccagcacatagacctccacctcggtcagggccagggcatcggcggcatggttggcgccgtccaggaagccgattcccccgatgatctcgccggggccgcaggtggccaggtgatagtgctccttcttgtggatgggcaaggtgatcttgacggtgccgcgccggatcaggaacaactcgtcgcccgagcttcccgccttgaacaccttcttgcccgcatggaccggacgaagcgtcacggcggcattcaggtccttgatggccttgggggacagcccggcgaacatggccatgtcggggatgtcgagaaccagatcctccccctggggcgcccccttggcggcgttgcgctggccctccacccattccagggcctcgtccagctggcggaaggcgaaggccttgttggtgggacgcaccaccccggtatccttgaggaaacgcttcatcttcaggccgctgggcaggcccttggggatgtcgcagaacaccagataggcgtcgttctcctccagccggtccttgatctgctccagcacatgggtggcggtgaggtccagggactgcacccggcgcatgctgagaatgacgaacttgcgggtctgggtctcgggctccagggcggcatgcagctggctggcggtgccgaagaacaggctgccctgcaattcgaagacgacggtgtcggacggcccctcctccgccccctccgcctcttcgccggaacgctggcgcttggagaagaggtggttgccctcgatgcggttgcggaccacggtgctgcgggtctgctcgcggatgaacagcaagatggcgaaggccactcccacgcccgaggcggcgatcaggttgacgaacagggcgaccacgatcaccgccgtgatcaccaggaaatccagccgcgtggccggcgtgttgaagaaggccagggaatgccggtcgatcatgcgaaagccgatgaccatcaagatggaggccagggccgccaccggcacccaggcgatcaccggcgacagcaccaggaaggccacgaagcacagcgccccggccatcaggcccgacacccgggtattggcgccgctgctgacattgatcagcgaggcgcccatggtcccggctccgggcacgccgcccaccagcgccgaggcgacgttgccgatgccctggcccaccaggtcgcggttgggattgctgctggaactggtcatggcgtcgaggacgacgcaggtcttcaaggtgtcgatggacagcagcgccgccagggtcagggcggggacgatgacctccagcaggatcgagggctccagcgcccccagggagcgccagtgctggccgatggtcgctcccaccccgaagcctccggcggaaatccgccccaccagaagcaggttcccctcgacctccagcagggccggatcgaaggccgcaaggccgaaataggcggcaaggcccgccgccagggccaggatggccggcggcaccgcgcgggtgaagcggggcgtcagcaccatcaccgccatgaccaccacgccgacgacgatgctctgccacgcccacaaggcgggcaggcgcagcgccgcccacaggcttggcccaccgggcacgccgagaaacttgggaatctggctgccgatgatgatcaggccgacgccgctgagatagccgcagaccacgggatagggaatgaacttgatcaggcggccgacccgcagcaggcccaggatgatctggaacagcccggccagaagggcggtcaggcccagaagcaggacgatgctgccggcgggcagcccctgttgggtaaaggtgatggccagggcggacagcatggccgcggcgggggcgcaaggggcgctgatcagccgggcgctgctgccgaaggccggggccagcagccccagggcggtggcgccgagaatgccggccaggcgccctgcgccgccagcgaaccgcccagcggcgcgaaaatggtcacgccgaaggcgatggccgagggcagggccaccagcattgcggcgagcccgccccaggcgtctcccgtgaatttcacgcggttataggctgtgtccagagccatcccacccccatcgaccggcctaccctttggaagtatccgcctcggcggaagaccggtcaaccgagtgtaactttggccttccggcgcgccgtcattgacaccggccgggcggcggtgctgttgttcccgccggaatacgcaaggacgacaccatggcgtggcttaagtcgattggggcgtggatcaaggcgattgggattgcggcgacgctgatgctgaccggactgtcggcctgggcggcggagcctgggggctcggactgggccaccagcgaatccggcaaggtccgcctggtctcggccgccaccgccacgggcgagagcgggcaactgcgcctgggcctgcatttcaagctggagccgggctggaagatctactggcgcacgccgggcgatgccggctatccgcccaagctggactggaccggctcggacaatctggacacgccccgcccctcctggccggcgccgcaccgtttcgtgctgtccgggctgcagaattacggctatgtgggcgaggtgatcctgccgctggatgcccgggctcccgacgcctcgcggccggtggcggcccgcctggcggtggaattcctggcctgttcccagatctgcgtgccgcagaaggtggatctgcgcctggacctgtcgccgggggcgggccagccctcggccttcgcccacgatatcggccgcttcgccgccctggtgcccggcgacgggcgccgccacggactgacgctggactccgccgaagcactgggtggcggtgagacatcggcgctgcggctcgcggtctcgtccaccgaacgcttcgacgcccccgacgccttcgtcgaggccgaggaggtggccgccttcggccagcccaaggtcagcctgtcgtccgaccgccgccgggcggtgttcgagattcccgtctctcccggcggcctgctcaagcccctggccggcgcccccatgacggtcaccgtcaccgacggcctgcgggccttcgagaccccgattcagccggttcccggcagtgccgcccccgcatcggcgggcggcgaggcgccgggactggcgggcatgctgctggtggccttgctgggcggcttgattctcaacctgatgccctgcgtgctgccggtgctgtccatcaaggtgctgggcgtgctgggccatggcgggggcgagcgcggccatgtgcgggccagcttcgtcgcctcgggaatcggtatcgtcgcctccttcctggccctggccggtctggccatcggcctgaagcaggcgggcgcggcggtgggctggggcatccagttccagcagcccggcttcctggccctgatggtggtgctgctggcgctgttcgccgccaatctgtggggattgttcgagattcccatgcccgccttcctgttcaaccggggcggcggggtggcccatcacacggtgctgggccatttcctgtcgggcgccttcgccaccttgctggccacgccgtgctcggcccccttcctggggaccgccatcggcttcgccctggcgcgcggcccctccgagatcgtcgcgatcttcaccgccctgggcctgggcatggcggcgccctatctggcggtggccgtctggccggatatcgccctgaaactgccccggcccggacgctggatggtcggcgtgcgcaaggccctgggcctcgccctggccggaaccgggctgtggctgctgtccgtgctgatggtccaggcgggggggctggccgccctggccaccggcggcgccatggcggcggcggtggtccttctggccctgcggtcccgcctgccggcggcggcgcgttcggcggtgggcgcctgcgtggtggccctggccggtctggccctggcggcgccgttccacggcaccgccggcagcgacggcggcaccggatcgggcggcgcggtggcgtgggagcgtttcgactcccagaccctggcccgcctggtctccgacggcaaggtggtgttcgtggacgtcaccgccgactggtgcatcacctgcaaggtcaacaaggcggcggtgatcgagcggggcgaggtggccagccggctgtccgcgcccggcgtggtggccttgcgcgccgactggaccaagcccgacgagagcatctcgcgctatctggcgtccttcggccgctacggcattcccttcaatgccgtctatggccccagcgcaccggacggcatcgccctgccggaactgctgagcgaggccgaggtgctggccgccctggacaaggcgcggtagtgcctcttccccctacaccgcgcggatttcgcccaggaaaccgtcgatagtggtcttgaggttcaccgcctcctcgcccatggccctggacgcatccagcacctcgacggcggcgccgccggtgcggcccgccgcgtcctggactccgcccacattggccgagacctcggcggtgccggcggccgcctgctcgacgctgcgggcgatctcctgggtggcggcgctctgctcctccaccgcgctggcgatgctggcggtgatctcgcccacctcgcggatgatggtgacgatatcggagatggcgcccaccaccttttcggtctgctgctgcaccgaagagatctgctggccgatctcgccggtggcccgggcggtctgattggcgaggttcttcacctcgcccgccaccacggcaaatcccttgcccgcctcgccggcccgcgccgcctcgatggtggcgttgagcgccagaagattggtctgggccgcgatgtcgttgatcagggtcaccacttcgccgatcttgcccaccatggtggcgaggccggtgacgtcattctgggcgtcgccggcttcggccaccgcattgccggaaatctccgccgagcggtgaacctgacggccgatctcctggatggaggaggtcagttcctcggcggcggcggccacggtctggacattggccgacgccagttcggtggcgcccgccaccaccgtggcccgatcattggtatcactggcggccgcgctcatggcggcggcggtgccctgcaaccgctgggccgccgacgagaccgccgcgaccatgcgctcggccgaaccctggaaacggttgaccagcgcctcgatggcccggccgcgcaattcgccgttatgagcctcggccagttgcttcctggccagatcatgtccccgcatcatggcgtccttgaagatctggaccgagcgggccatggcccccatctcgtcggcccgctccgttcccccgacgctcacgctgaagtcgtcagcggccaggcgttccatggtgccgaccagggaaccgatggccgaggtcagctggcgcaccacggtccaggccacggccagggcaatcaccagggcggcgacgacgcccaggacggtggtgagcagcacgcccctggcatcgccgttgacctgggcggccagggcctggacatcggcggccatgtggtcctcgaccttcttcaaaagattgatgcgcgaggtggcggcggcgaaccaggccgggccggtgacatcgccgaccgtgccggtggcggggctgtccagaccgaccttgcgcatgcgctccaccgtgcggcttgcctcgtcatccagggtggtacggaagaaatccacctgggcgggggcggcgctttcctgaaactcccccagaaacagctgctgctcggcgacgatggcgacgaagcggcgatagacctccggctcgaacttgcccgaggagaaggcgccggcagcggtggcccgctcctgcccggccttttccttgccctccatcagcttgagataggcgccgatcatgcgccccaccctggcgtcactggacagtacggcgatctggttgaccatatccaactgaaaccgaatggtttcggtgaagttgcccagggcggtacggccgtccatggccagggcatcgatggcgccccggctggcgatcagcgcttccagacgctttgtcgccttgtccaccttgggtggaaagctggcacccagggccgagacgtcaatcccggccagggaccgggtcagcttttcccgcgccgcgtcggtcagctggcgctgggccttgagttccgcgccaaacttctcgcccttgctgccgatgaagacggccgaggcgccgcgttccttctgcacttcgtgcaccagggcgctgatctcggcggtcagcggagcgatcccggccagcgtcgacgtctccgacaccacccgcgccttgtcactgatcacatagcccgccagcccaagaatcagaatgaccgggaacaagaaggacagggcaatctttgctgaaatcctgagatcggtcagccggaacatgggcaaccctccgaacctgaactctctggacaggagccgaagctccccatccaggacccgccaacaccatacaaaggtcatggctaaacatgctcaatgttgtattgctcgagcatattttcaagcagggaagtgtcacggcaggaatttgcgcacggaatcagaccgcccgctcgccctcctccaggcggcggaagaccccgggcggcagtcgggtggccttgtcgcagatggccttgtcgacctgggcctgggtcaggttctcggccttggacaggtcggcgtcgcgaagatcggcgcccatcatgatggcgcccttgaagtcggcgccggcggttcgcgctccgcccaggctggcgccggacaggtcggtgccgcgcagcacggcgccttcgagattgctgaggttcagcttggcgtgccgcatggccgccacccccagattggccccgcccagattggcggcggacaaggtggcatagcggaagtcggacccatccagacgggcctcggccaggcaggaatccgacaggtccacctcgcggaaggtggcattggcgagaatggcgccggacaggtcggccccggccagatccatgccggtgaaggtggcgcgcttgccctcggcgccattggtctgcagccacttgccatgctcggccaccacggccgacacgtccagcgccgccacgtcgcggcccttgcgcgccttgtggcccgcctggctcatggcctcgtcccactccttgcggcgcttggcggcacggcgtttggcggcctcggcatcgggatcggggcggatgcccgccacctcgatggggccgtcggacagcttgcggacgggcgccagatcgtcatcggacagcttgcccccggcgacccggcgggcgggagcctcctcggagaccgaggcgaagccccggttgctcggcgcgggaggggcgggggatgtggcgggagcgggcttttggactggcttcggcgccggagcgggcggcgcggcctgagcgggcggcgacggcgccttgccctgcagaacctccaccggcccgctgcgcgacggccggggctcggccagcgaggccgccgcgccggtgcgggcttccagccgcgccatcagggcggccacttcgggaatgggctgggatgcggcggacttggccgcgcccgccggaccggcgccctccgcgtccttcatctcgggcagcgggtcggcgtccttgatgaaattgcgcttgggggcatcggacaggctggcgggcggcgccatgcgctggggggtggccagggtctcgcccacccggtggcccagttcgtggcccgaaatgggcttgggaatcacgccctcgatgcccaggatcttggcgcggtcgagggtatccttgagggtcgagggcgccaccgccagcaccggcagggcctcattgggattgccctggggctggcgtaccccttcgagcacccgcaagccgttttcgggatgggaggcgaaatcgattagcaggatgtcgaatccctgcaccagcagcttgcccagatcggcgagctgatcgaaggacgccacttcgcgcacgttcagcttacgaaaagtctggcgggcaaggaaacggaactggtcgtccaggccgaacaccagcaccctgaccttcttccagtcggttccctgaaccgactgagtcactgtcggatgacgcatctacgcacaaaccctcatcgctcccgccccgccacaatagtcatcgccacgggcgggagcaatcgtcgaagagtggcggaatctgttggcgttgcgtcagtggcggaccggattccagccgggatggtcgaaatgggcctgatagcggtccaacgccttgaccgccgccaccacgccctggctccgctcgccgcccctgcccttcatgacatcggtggcggtcataaggtcggccagcacgatgtggatctgggcatcggcggcctcgggaagcttgcactgcagggcgatgccgtcgatgtggcgggaaatggaggccgccagggcatcgtaatctcccaccgtgtagcgcctgtcatgcaccggtcccagggcggcgcgcacctcgccgccgatggccgccatcccctggcggagcggggcatcggtctgccacttgcggccgtggtcgagggtcagcgccccggccgccggtgccgcgccctcatgggcgtgatcgtgggaggacgccgctatggccggggcggtaacggccagggcggcaagcaggaaacctgtggcagcggtgcgggacatgaggtttttctccggagtgatgctggcccggagcctatccgcccaaacatgaaccgaagatgaacctttaactccatcgcttccgaggttgcgacacgaccgccgagccctcattttgaggagatgagaagacgagacccatcctcctgggacaaggggcgcggccaggggcccggcgccgactggaccacgctccgcacgctgttcccttatctgtggccgccgggcgaggccgggctgcggctgcgggtggtcgccgccatgatcctgctggtggccgccaagggcgtgggggtcggcatcccgctgctgtacaagcaggcggtggacaccttgtcggcatcgccggtcctggtgccgctggccctgctggtggcctatggcgcggcgcgcgtcatggccggcagcttcgccgagttgcgcgacatcgtcttcgtcaaggtggcgcagcgggccatccgcaaggtcgggctgggggtgttcacccacctgcaccgcctggggctgcgctttcacctggaccgccagaccggcggcgtgtccagggccatcgagcgcggcaccaagggcatcgagttcctgctgaacttcatgctgttcaacatcctgcccaccctgctggagatcgggctggtcaccgccatcctgtggggcctgtatgacggggtgttcgccctgatcaccgcggtgaccatcgccgtctacatcgccttcaccctgggcgtcaccgagtggcggaccaagttccgccgcgccatgaacgagacggattccgaggcctcgaccaaggccatcgattccctgctcaatttcgagacggtgaagtacttctgcaacgaggcccacgaggccgggcgctacgacaaggcgctggcccgctacgagcatgccgccagcaagagcaaggtgaccctgtccctgctcaacatgggccagggcgccgtcatcgccgtgggcctgaccctggtgatgatccgcgccgcccagggcgttgccgacggcaccatgacgctgggcgatttcgtgctggtcaattcctacctgatccagctttacctgccgctcaacttcctgggcttcgtctaccgcgagatcaagcagtcgctgaccgacatggaatccatgttccgcctgctgcgggaaaacgccgagatcgaggacgccccaggggccggcccgctggccctgcagggcggcgaggtgcggttcgaggccgtcagttttggctacaatcccgaccgccggattctgggcggcgtcgacttcaccgttccggccggcaagacgctggccatcgtcgggccgtcgggagcgggcaagagcaccatctcgcggctgctgttccgcttctacgacgtggatgagggccgcatcgtcatcgacggcgccgacatccgcgacgtgacgcagtcgtcgctgcgcgccgccatcggcatcgttccccaggataccgtgctgttcaacgacaccatccgctacaacatcgcctatggccgccccggggcaagccaggacgagatcgaggccgccgctcggctggcccgcatcgacgatttcgtgcaaagcctgccccagggctacgacacccgcgtcggcgagcggggactgaagctgtcgggcggcgaaaagcagcgcgtcgccatcgcccggaccattctcaagcagcccgccatcctgatcttcgacgaggccaccagcgcactcgacacccagacggagaaggagatccaggagagcctgcgcgaggtgtcgcgcaaccgcaccaccctgatcgtcgcccatcgcctgtccaccgtggtcgatgccgacgagatcgtggtgctggaacacggccgcatcgtcgagcgcggccgccatgcccggttgctggaggccgatgggcgctatgccgccatgtggcgccgccagcaggaggcccagaccctgcagcggcgtctggccaccgaactgatgggggcggaatagcccagtcccgcgctccgttgccgccggcttggaaacgtgacagagttcacgggtatcaccgatagaaggaggccccgatgttccccagtttcgaccccaagatgttcgaggccttcagcgccgatccggcgtccttcctgggcaaggtcgccgagttccagcgcgccaatttcgaagccgcccgcgagatcaccgagaataacgccaaggccttccagcaactggccgccatccgcgacccgcagcagttcgtcactgcccagcccgccatccttcaggcggtggtgcagcggaacatggagatcgtcactcagctatggcagaccctgggcggagaaatgtctccccccgcccccaagggcaagggcaagaaataggccgtcgccccaagccctgccggttactccggcagggtgaaggtgaaggtggatccttcgccgggcaccgaattcacccagatccggccgccgtggcgctcgacgatgcgcttgcagatggccagtccgatgccggttccttcaaagcagtcacgggtgtgcagccgctgaaagatgcggaatatccgctcggagaactccggcgagatgccgatgccgttatcggccaccgagatttgccagtactcgccgtcgcgaaccgccgataccaccacccgcaggggccgggacggctcgcgatatttcaccgcattgccgatcaggttctggagcaactgcgccatctcgccacgcacggcgggaatggccggtaacggagaccggcattccacgctggcgccgtattgggcgatggccggtgacagattggccacgacgccatccaccacctcgcccaggggaaccggctccagcggctcctccatccggccgacccgcgagtattccagcaggtccagcacaagctgatccatgcgctgggcgccttccttggcataggcgatgtactcggccccctcgtcgccgaccacggggccgaagcggcgctccagcatgcccatataggcgctgaccatgcgcaatggctcgcgcaggtcatgggacgcgatgaaggcgaattgctccaggtcggcattggaccgggccagttcctcggtcttggccatcaaggcccgctcgaccgcctgggattcggtgatgtcctcgacgatggaccagatatagctttccccgtcgcggccggtggccaacatccccgacagccggacgggaacccgtcggccgtccttgcggatgtattccttctcgtagggcccgtaatgccccagggcctccaggcgctccagctgggtggcctcgtcctggccgaaacgcaccggggtgaggtcccagtaactcaggctgcgcaaatcctcaatatcgtagccaacgatcccgagaaaggccggattggcctcgagaaaactgccgtcgacacgattgcgcgccatgcccagcggagacttctcgaacatggcccgcagcttctcctcgttggaacgcagctcggcctccacctcgcggcgacccgccatatcctccaagaggtgctgttccgcctgacgccggcggtccatttcatcgcgcatgcggccgatcaccgccaccagcaccgccagttcggcgggcgccaccaccagcggcgcgaagaaagcccccgcccagaccaccggcggcacatggccgaccatggctaggctgaccagggcggcaaccagttcggctaccagcacggcaaaggcggtcccgccaaaaaacagcaggttcagcggcaaaggcagcagcagccgtaccacggaatcccggaagacgccgctcccatgccccccggcacgcacaatttcactttctgccgacgcccctggcaccacccaaaccccgatgaacaagaaacaaaatgtagcgatttatgtccattcatagagtatggtcaggttaaacccgtatcaacacttaagttatggcctatccctttgcaccgacggtttaccccccggtgcaagcggcgtgcttgctcccttcgcgccgcatggttagtgtatccctcttttacgtttcgccctcgaagaggctttcccttgaagtatgtgagcacccgcggcgccgcaccggcccttgatttcgacgacgtcctgctggccggtctggcccgtgacggaggcctgtatctgccggaaagctggccggtcttctccgccgccgacatccgcgccatgcgggggctgtcctacgccgagctggcggtgcgcgtcatgcgccccttcgtcgagggctgcctgaccgaggccgagctgacccggctgtgcgccgagtcctacggcgccttcgcccatccggcggtggcgccgctcaagcagctgggtcacaaccagtgggtcatggagctgttccacggcccgaccctggccttcaaggactacgccctgcaactggtcggccgcctgttcgaccacgtgctgaagaagaaggggcaaaaggtcaccatcgtcggcgccacctcgggcgataccggctcggccgccatcgaggcctgccgcgaccgcgccgcggtggatatcgtcatcctccacccccatggccgggtgtccgaggtgcagcgccgtcagatgaccacggtactgtcgtccaacgtgcgcaacgtggccgtggacggcactttcgacgattgtcaggatctggtgaaggcgctgttcaacgacgccgccttcagagacgagatgaacctgtcggcggtcaattccatcaactgggcccgcgtcatggcccagatcgtctattacttcgccgccggcgtggcgctgggcgcccccgacgtgcccatgagcttctcggtgcccacgggcaatttcggcaacgtcttcgccggctatgccgccaagctgatgggcctgccggtggagaagctgatcatcggctccaacaccaacgacatcctcacccgctttttcgaaggcggggtgatgaaggccgacggcgtggtccccaccctgtcgcccagcatggacatccaggtctcgtccaacttcgagcgcctgatgttcctggccctgggaggcgacggcgccgccgtggccaagctgatggatgacttccgcaagaacggcgccatggtcatgccccagggcgcctggaccgccatgcgcgaggtgttcgagggctaccgcttcgacgacgaggcgaccctggccgccatgcgctcgctcaagcgctccaccggcgagacgctggacccccattcggtgatcggcgtcgccgccgccctgaagggccacgccgcccgggattgctccatggtcgccctggccaccgcccacccggccaagttccccgacgcggtggaaaaggccaccggcatccgccccggcctgccgccccacatggccgacctgttcgagaggaccgaacggcttgaccggatgggcaatgatgccgatctcttgaagcagtatgtgcgggccttcgcccgtcgggaaaacgcatgagcgagatcagggagacccgacttaactccggcctcaagatcgtcaccgatcccatggacacggtagagaccgtgtcgctgggcgtctgggtcgatgccggcacccggcacgagcccgccgagatcaacggcgtcagccatctgctggagcacatggccttcaagggcacggcgcgacgctcggcgctggacatcgccgaggagatggacgcggtgggcggccacctcaacgcctacacggcgcgcgaccacaccgcctattacgccaaggtgctgaaggaggatgcggcgctggcgctcgacatcatctccgacatcttgcagaactcgaccctggaggccgaggagctgggccgcgagcaggcggtggtggtccaggagatcaaccaggccatcgacacgcccgacgacatcatcttcgaccacttccaggccaccgcctatcccgaccagccgctcggccgcccggtgctgggcagcgaggaactggtgcgggccatgagccgcgatcaggtgatgggctatctgcgcggcaattactcggcgccgcgcatggtgctgtcggcctcgggccgcatcgaccacgaccatctggtggccgcggccggggcggcgttctcgcaactgccccctcatcacgcggcggtgaccgatcaggcccgctatgtgggcggcgattaccgcgaggaacgcgacctggagcaggtccacgtggtggtgggcttcgacggcgtcgcctatgacgacccggactattattccgcctcggtgctgtccaccctgctgggcggcggcatgtccagccgcctgttccaggaagtgcgggaaaagcgcgggctggtctattccatctattccttcgcctcgtcctacaacgacggcggcctgttcggcgtctatgccggtaccggcgaggacgaggtggccgagctgatcccggtcatgtgcgatgaaatcgtcaaggtctgcggcggcgtcaacgagcccgaggtgcagcgggcccgcgcccagctcaaggcctcgattctgatgagcctggaaagcaccacgtcgcgctgcgagcagttggcccgtcaggtggtgatctatggccgcccggttccggtggctgaggtggtggaaaaggtcgaagccatcaccgccgaggattgcgcccgggtggcaaggcgcctgttcgcgggaacccccaccttcgccgccatagggccgctgggcaaggttgaggacttccagcgggtggccgaccgcctgaggccctgatgcgccgcagccttttcgcccttctcgccctcgcctggctggcgccgtcgccgacggcggccctgccagtcaccaccggcgtgtccaaccccaccatcgtggtggcgatcatcgccaccctgtcggggccgggcgccatggcgggccaggacagcgtcgacggcttttccaccgccatgcgccatctgggcggccgcttctccaaccaggaagtgcgcgtcgtggtccaggacgacaagggctcgcccgacaccgccctggcggtggcgcgccggatgatcgagcgggaaaaggtggacttcgtggtgacggcggtggggctgccctccatgacggccatggtcaagaccctgaccgaatcccgcgccttcgtgctgaacctggacgccgcgcccgccagcatggccggcgcgacctgctcgccctggtacttccaggtggcaacgccggtccaggccatccacgaggccatcggcgcccatctcggcgccgagaaaatgcgccgcgtggcggtcatcggcaccgacgcccccgccaccgatcaggccattggcaccatccgccggtcctggccgggcgaggtgatcgagatccgacgcccgcgccacggcgccacccgctataccgaagagatcatcgccatccgccacgcctcgccggacgcggtgatcaacctgctgaccggcggcatgggcggcgccttcgcccgcgaatacgccgtctccggactgaagggcgacgtgccgctgatcggcgtctggcagggctgggagcgccccatgctccccgccatgaccgaagcgggcatggacgtgcttaacgtggcgccctggagccccgatctggaaacgccgctgggcaagcgcctgatcaccgatttcgaactggaatacggccgcccggttaccggctgggtcgcccagggctatgacaccgcccagatgctggacgcggcgctacgcgccaccggcggacgcgccggcgatcgcgacgcagtgcgcaatgcgctgagacgggcagaattcccctcggtgcgcgggaccttccgcttcgacaccaaccattccccctcggtcaatgtctatctgcgacgcaccacccgcgacgccaaggggcggccgaccgaggagttgcgctcgaccctgctcaaggactggcacagccgcgacgtggccctgtgccccatgcgctggaccgaggaaccggcccccggccatgcgccgggcaccgcgccccccaagcccagcacccccgccgccgcgcctggacagccacccaagccgaaaccgccgacggttccgggccagcagcctccggccaagccaaagccaccggcagcggcgcctcctgtcggacaggcacgctaaacgatcatgtcatcctgagcgcagcgaaggatctccgcctggaccggcggcgccaattctgaaaagccgtgccaggatgagatccctcgcctccgctcgggatgacacttcatccttatccttccggaaaacgcccccgctaccggtgcttttccaccagcttgatcatggtgtcgagggtgatggaggcgaaggtggcgcgtgccgtgtcctcgatctccatcagcacctggcataggcccttgccctcggcggtgtcgtcgccgtcttcccgctcgccgtggcggatggggtcgatggtctcgaacagctggatgatgtccagcagagtggtgcgccgccggttgccggaaaagcggtagccgccgccggcgccgcgcaccgcctcgaccaggccgacgcggcccagggagcgcagcaccttggccagatggttggtgctgatgccgtacttctcggcgatctcgttggccgagagctggcggtcctggcccgaggccagttccaggatggcgaacagggcgcagcgcgtggctttctggagcttcatcagagatccttctcgaactggatgaagggaccggccatcatgccctggctgcggaagaagctcatgatcagggtgtcgtcgcgcgccagcatggtccgcaccttggagacgcccgccttgcggaagcggtcgttcagggcttccagcagcacatggccgacgccgccctggcgggtgttgttgcgaacaccgatggcaaaaatccagccgcaagggggagaaccgaactcccaggcgcggacttcaccgatgatgaatccaagaaccgcctctccgtcacaggccaccaagaaaaatcggtaccgttttacggatttcggctgagtgtcatcatccacatcagttgagcggctattgtaacgctccaacaaatcttcccaatactcggccttggacagaccagtattctcggtatcgatcgcaatcacttgcggaatgtccgtcgcctttgcgaggcggacggtgcattttctttccgattgccgagcctgtggatttgccatcgagaccgtctccagtactagtgaaatcgttctactgcacggtgccggtgattacaatgccgtttctgacacggcacctttgtcgctacgcgaaagtatcacggccgccatgcctcatatctgcacggggcgggttggcggatgcccttgccgggtgtaggcttttttctccaatccccggacaacaggggacaggccatcgttcaagagcgtggctttcgccatgcgcgaggtggggagaattcgaatgcccaaagggaatcccaacggttccgacgccggcaccgttgtgtcggcggttctggcccgccacggggccgatggcacccggctgatgcagatcctgcgcgaaattcaggaagagaccgagtggctgtcgcccgacatcctgacccgggtggccgagggcaccaggctgccccgcggccaggtcgagggagtggcgggcttttaccacttcttccataccgagcccctgggccgctatcgcgtgctgtggagcgacaacatcaccgaccgcatggccggcaatgccgacctgatggcccgcatgtgcaagaagctgtggctgaagccgggacgggtctccgaggacggcctggtcagcgtcgacaccacgtcgtgcaccggcctgtgcgaccagggtccggccctgctggtcaattaccgcccgatcacccgcatgacggcccagcgggtggaccagatcgtcgagctgatccgccacaagacgcccctggccgagtggccggcggaattcttcaaggtggaagacaatatccggcgcaaggacgccctgctgggcgccgactttgctcccggtgacgccctgaaggcgctgaagagtccccaggaggtgctggattccgtcaaggaatccggcctgcgcggccgtggcggcgccggcttctccaccggccagaaatgggatttctgccgcgccgccgtgggcaccggcccccatgccgcccattacgtggtgtgcaacgccgacgagggcgagcccggcaccttcaaggaccgcgtgctgctggcctcctacgccggtctggtgttcgagggcatgaccgtctcgggctatgtcatcggcgcccgcaagggcatcgtctacctgcgcggcgagtaccgctacctgctggagccgctgaacgcggtgctggaaaagcgccgcgccgccaagctgctgggcaagtccatcctggggcgcaccggcttcgacttcgacatcgaggttcacctgggcgccggcgcctatgtctgcggcgaggaaaccgccctgctggaaagcctggagggcaagcgcggcgtgccgcgcaagcgtccgcccttccccgtcaccgcgggctatctgggccagcccaccgccgtcaacaacgtggagaccctggcctcggcagccctgatcgccgccaagggcgccgcctggtacaaatccatcggcacccccaaatcggccggcaccaagatcttgtccatctcgggcgattgcgagcggcccggcatctacgaatatccctatggcgtcaaggtgtcccaggtgctggccgattgcggcgccagggatacccaggcctgccagatcgccggcgcctcgggcctgtgcgtggcgcccaacgagttcgggcggcgcatcgccttcgaggacattcccaccggcggctcgttcatgatcttcgacaacacaagggacatgttccaggtggcccgcaacttcgcccatttcttcgtgcatgaaagctgcggcttttgcaccccctgccgggtgggcaccacgctcttggccaatgccatggacaagatcgacgagggccatggcggcgaatacgacatcaacgacatctggcgggtcatccgcacgctgaagaccgccagccattgcggcctgggccagacggccggcaacgccgtcgccgacacgctgcagaagttccggccatcctacgagcttcggctcaatgtgcgcgacttcgaacccgccttcgatctcgacaaggcgctgtccaagatgcgcgaggtgacgggccgcgacgatcccggcgcccacttccacatcgcccaccggaaatccagggccggcctcggcaccaaggcgggagacccgtcatgagcgatcccaagaccttcttcctcgatgaagaggaaatccccttcgaggaaggccagaccatcatccaggcggcgctgaccgccggcaaatatatcccgcatctgtgctaccacccggaattcaagccgcatggatcgtgcaagctgtgcacggtgcgcatcgattcgcgcaccgtgaccaccgaggacggtcaaagcgtcaagatccccggccgcgccgccgcgtcgtgcaccacgccggcccaggcgggccagcatgtggaaagcgaggtgccggaaatcctcgatctgcgccgcaccctggtgcagatgctcctcgtcgagggcaaccactactgcccctcttgcgaaaagagcggcaagtgcctgctgcagggtctggcctacgacctgggcgtgatggacccgcacttcccgcaatatttctccaagcgcgaagtggacgccagccaccccgacatcctgctggacctcaaccgctgcatcctgtgcgagctgtgcgtccgggccagcgccgaggtggacaagaagaacgtcttcgccatttcgggacgcggcaacaccaagcacctgatctgcaactcggaaagcggtgaactgggcgacaccaatctggccgccaccgacaaggccgccaatgtctgcccggtgggcgtgatcctgcacaagcgtcacggcttcgaggtgccctacggccagcgtcgcttcgacaaggcgcccatcagcgacaatccggtgcaatacgcgcccgtcaaggagcaggtgtgatgaacgctcccctccccaagcgcaagctcaaggtcgccaccacctccctggccggctgtttcggctgccacatgtcgttcctcgacatcgacgagcgcatcctcgatctggtggaactggtggaattcgaccgctcgcccatcaccgacatcaagcattgcagccccgattgcgacctcggcatcatcgagggcggcgtgtgcaatgccgagaacgtccatgtgctccacgagttcaggaagaactgcaagatcctgatcgccatgggggcctgcgccatcaacggcggcctgcccgcccagcgcaactcgctggacatcagggacatcctggccgccgtctacgcccagccggggcgcggcgtgcacattcccaacgatccggaaatcccgctgctgctgaacgaggtgcatcccctgcacgaggtggtcaagatcgactacttcctgcccggctgcccgcccagcggcgacgccatctggaagtttctcaccgacctcttggccggccgcacgcccaccctgggccacggcctgatccattacgactgaaggaacggccgcgatgaggcaccaattcgaactggaaaccgccaagacccccgaggcgctgaagcgcatcgtcatcgagcccgtgtcgcgggtcgagggacacggcaaggtcaccatcctgctggatgacaacaaccaggtgcatcaggtgcgcctgcacatcgtcgagttccggggcttcgagaagttcatcgagggccgcccctactgggaagtgccggtgctggtccagcgcctatgcggcatctgtccggtctcgcaccatctggccgcctccaaggccatggacatgatcgtcaatggcggcatcctgacgcccaccgccgagaagatccgccggctgatgcattacggccagatgctgcagagccatgccctgcacttcttccacctgtcgtcgcccgatttgctgttcggcttcgattccgatgtggccaagcgcaacatcgtcggcgtggccgccgccaatccggacgtggccaagatgggcgtgctgctcaggaagttcggccaggaggtgatccgcgtcacctcgggcaagcgggtgcacggcaccggctcggtccccggcggcgtcaacaagtccctgaccgccgaggagcgcgactatctcctcaaggattccgaccagatgatcgcctggagccgcgacgcggtgcgcatcatcaagggcctgcaccgctccaacccggcgctctacgacgccttcggcgcggtgccctccaccatgatgagcctggtggacgacaagggggcgctggacttctaccacggcgcgctccgcgcccgcgacaaggatggcgaggtcatcttcgatcaggtcagctatcagggctacaacaccctgctgaccgagggcgtcaagtcgtggagctacatgaagttcccctacatcaccaccctgggcgaggagaagggctggtacaaggtcggccccctggcccgcatccagaactgcgacagcatccccacgccccaggcggaggaggagcgggtcgagttcgtcgcccatggcggggccaagcccatgcacggctcactgggcttccactgggcgcgcatgatcgagatgctgtgcgccgccgagaccatcaaggacctgctgctcgaccccgacatcatgggggccgacctgatggcggaaggtccccggcgcggggaaggcatcggcgtcatcgaggcgccgcgcggcaccctgttccaccactaccgcgtcgacgacaacgatctggtgacctatgccaacctgatcgtctcgaccaccaacaacaataccgccatgaacgtggcggtccgggacgtggccaagaactacctgcaggggcacgagatcaccgagggattgctgaaccacatcgaggtggccatccgctgcttcgacccctgcctgtcctgcgccacccatgcgctgggcaagatgccgctggaagtgaccctggtcgacgccacgggggccgagatcgaccgcatgaccaaggacagcgaggggcggatcggaaagtgagattttccccagccctgtcgcgtcatcccgagcgaatgcgagggatctcatcctggaacgacgtttccctttcgaaaacgccgcaccagatggagatccctcggctgcgcctcgggatgacaggctgagatgccatgaccgcccccaccctgatcttcggctggggcaatccgtcgcgcggcgacgacgccctgggcccggccctgctggacgccgtcgaggcgctgctggacgcccatccccactgggggccggtggacatcctgaccgacttccagcttcaggtggagcacgccctggacctggagggccgcgaccgggtgctgttcgtcgacgcctcgtcggcaccgggcgacgcgccgttccgcgccgaggccatcgccccggcccgggactcgtccttcagcagccatgccctgtcgccccagggcgtcatgcatgtctatacggagatcaagggaacggcgccgccgccctgcaccctgctggccatcgccggcgaggccttcgagttgggggagcccctgagcccggcggccgagagcaatctgaaggctgccttggcctggacccgggactggctgggacgccggcccgcctgaacgggttgggaaatccgttccccgcatggccgactgcccaagacagcgcatgtgggccacgggatagaacgctattgttgccaagcttgtgaacaggggtattccatcatgtccgaatccgacctgatttcccgcctgcagggctttcccgcccccgcctgccgctgcgcctcggcggcggagaccgggcggcacgacggcaattgcctggctggcctgctggccgaatcggtggccgaaatcgggcgtctgcgggccgagaacggccgattgtcctccatgacggtgaccggcgccccgggtcgcgccgccgaccgtcaggtctgcgtgcgcctgatgtgctattacggctcggacggggtgtggaacagcgaggacgagaccgccgatcccgccccgctgctgctgtcgcccggcctcaaatccgagatcgtggcgtggaagcaatccctggaccgggtcgaggcggtgacccccgccgtgaccgaggccttccagacccgggcgctcaacatcgcccggcgcatcaaggaagagatgccgggctggaaggtggtctatatcgatcgcaccaagtcgggcgccgacatccgcaacaaggactatttcgagcacgaagtgacgctgtgacccctttgccgtcattccggtgaaggtcgagctccactccggcgcgcccgccaagcccgcttacgggcaggcgtgcaacggctgcggcctgtgctgcgccgtggccacctgccccctgggaatcgtcctgttccaccggttcaaaggtccctgccccgccctgcaatggagggatgatcgctatgtctgtggcgtgctggccgaaccggggcgcttcgcccccctgcttccccgccgctgggcggcaaggctggtggcgcgctggatcgccgccggcaagggctgcgactgccgccacgaggtggggtgaaggccgcagccttcagcggggctgccgccccggccccgcttggagacgaggtctccaaacctctcttttgcttcttcatgaaatcaaagggggaccggggcatcgccccgggcgggtgcgggcggcagcccgcccttgagttgctctacccctcgtagaacttcgaccagctgcaggcgcggcacgaccccacggctccggcttcggtctccagggaatagcgcacccggctgccgcagacggggcaggaggtcgggcgcttgggcggcgttctgaccggaaccgacggcacccgccgcagcagcgacttgatacgggccagcaattcgcgccggtcgcacggcttgctcaggaattcgtcggcaccgatttccagaccgtgcagcttgtgctccagggccgtgtgaccggtcagcaggatgatgcccagggcgaaacgctcgcgcaggcgctggaccagggtatagccgtcctcgcccggcatctccacgtcaagaagcaccagatcggcgggaccggcggccagggccgcccacatctcctctccgccgccacagggagtgacgcggtacccctgggcggtcaggatgccggaaagaatcgagcggacggtggcatcgtcgtccaccaccagaatgtgggcgggtgtcatgaacggtcgaaagagccctggctagtcgtcgcggttcttgttgccacgacccggattttcccgctcgcctcgcccgtcacggcggtgctcgtaggagtttcccggcccgtcacggcggtcccgatcacggtagtcgcgatcctcgcggcggtcccggtcgtcgcggcgatcccggtcacgcacgtcgcggtcgcgatctccacggcgatcacggtcatcacggtcgcgatagttcctgtcgcggtcgtcgcggcgatcacggtcacgcacgtcgcggtcgcgatctccacggcggtcccggtcatcacggtcgcgatagttcctgtcgcggtcgtcgcggcgatcacggtcgtcgcggcgcggcgcggccttgtcgacggtgtcgcgggcagcctggccggcggcatcggtggcggcatccttcaggacgcttcccaacccgccgctatcggcggcggacgcctgtccagcggccagccccagcatcaggggaaccagcagaacccagactttcatgaccacctccacggattgcctggccaaagcctacgacgaaatccataggccgtataggagctaatccacagaagccacgtcaccccgggcaatggtcagggccttgatcagggcatggacccgcatccccggcaccagattcagctgggcctgggccagggtggtgatctgcacccagaaccgggtgggaccacaggccaggatgacgtccaccaggaacgaatccgccggagccaccgaaaccacgatggcgggcagcacgttgcggatgctgacccggtcgggaggctcgatggcgatggccacatcgcgggcgtggatgcgcagccggaccttcgcccccaccggcaactcggaccgcccgacgatcagcgtgccgccgtcgaaggccaggcggctgatgccgaagccggaatcgtggctggagaccacggcgccgatcacggcaccagcttcgtagcgcccggtcagcggccgcagccccggatcgcccatcaggctctccagcggcccggaggcggccactttgccgccatccatcagggccagggtatcggccaaacgcagcacctcgtccatggaatggctgacataaaggatggggacggaaaaccggcgggccagttgggcgatgaagggcagcacctcggccttgcgcgccgggtccagcgccgccagcggctcgtccatcagcaggatgcgcgggctggccagcagggcgcggccgatggcgacccgctgcttctcgccgcccgacagcttggcgggtcgccggtccagcagggactcgatgcccagcagttcgaccaccttgtcgagggattgggtgcgctcggcgctgggcagcagcttctgcccgaattccagattgccgcgcaccgaaagatggggaaacagccggtgctcctggaaaacatagcccaggcgccgggcctcgggcggcaggtcgattccggagcgggagtcgaacagcacccttccgtccacgctgatggagccctcgtcgggacgcgacagaccggccaccatgttgatcaccgaggtcttgcccgagcccgagcggccgtaaagcgccgtcacccctggtccggccgacaggcggacatccaggcggaattctccctggcggcggcggagatccaggtccagcatggcgcccctaccccttcagccgggcctggacgcggcgcgccagatattccgaggccagcagggcggcgaaggccaccaccaccgagatgacgcacaggcgcaacgccgcctcgtcgccgcccggcacctgggtcagggcgtaaagggcgatgggcagcgtccgggtctcgcccgggatgttggacacgaaggtgatggtggcgccgaactccgacagcgagcgggcgaaggccaggatcaccccggtcagcacgccgggcagcatcagcggcagggtcaccgaccagaaggtgcggatggggccgcagcccagggtccgggccgcctgctccagaccacggtcgacgccttccagcgccagccggatggcgcggaccatcaggggaaaggcgatcaccgccgaggccaccgccgcccccttccaattgaaggccagagtgatgccgaaccagtcgtagagccagccgcccaccacgccccgccgccccagcaccaccagcaggccgtagcccaccaccaccggcggcagcaccagcggcagatggatgatgccgtccaccacgaccttgccgggaaagtcgagccgggccagaacccaggcacaccccagccccagcggcagcgacgcggccaccgcccagaacgacaccagcagagacaggcgcagcgcctccatctcgagcggcgtcagggtgaacatggtcgtctccgtcccttggattacgggccggggactaagacatcacgcataaagcggatagacaagacgttccggcatctcgtggaagccgaaattattcttgcccgcccccttgaccgtgtacatggcccggtcggccagacggatcagcatggcggcatcgtcggcgtcgtcggggaagatggcgatgcccacgctggcctggacattggcgtcatgcccgtccagttcaaagggttcggccagccgcgagacgaccttggccgccacgttgccgatctcgtccttgccctccacgtcgtggaggatgacggtgaattcgtcgccagacagccgcgccaccgtgtccgacgagcgcaccgagagcaaaagccgcgccgccgcctcctgcagcagcaggtcgcccaccgcgtggccgaaggtgtcgttgaccttcttgaagccgtcgagatcgatgaacagcagggcgaagcgggtcttgtcgcgcttggcggccttgaccgcctggcccaggcggtcgaggaacagcgagcggttgggcagaccggtcagcgcgtcgaaattggcctggcgccacacctgctcctcatcctccttgcgcgccgtgatgtcgctgaagatgcccagcatgtgggacacctcgccgaaggcatcgcgcaccgtggcgatggacagccactcgatgaacacttcgccggtccgccgccggttccagacctcgccctgccactggccggtctcgaggatggcgcgccacatatcgcgatagaagtcgttttcgtgccggcccgatttcaggatgttgggcttcttgccgatggcctcgtccagggaaaagccagtgatgcgggtgaaggccgtgttgaccgcctcgatggtgccgtcggggcctgtgatcatgatgccttcgttggcggtttccaccaccttggccgccagttgcagccgctcctccgaggtcttgcgctcggtgatgtcgtagacccaggccaaattgaccggctcggtcccgaacagagattcgcggatggtcagcagcgtccagaacggcgccccgtccgagcggcggaactgcacctccgcatggtcgacgctgccgtggcgcttcatgtgcttgatcaccgtggcccgctgatgatcgtccacgtaatagtcgcgggccttggatcccagaaccgtgacccgcggcacgccgatcaggtcgcagaacgtatggttggcgaaaacgatgacgccgtcgcgccgccgcgagatggatacgccgatggggctgtcttcaaggacgccggccaaaccgatgggatcgagctcggtcatggccacaaccgggaatcacgatggatcatgttctccccccttgtttggctccccccgaagccacgggccttcgcccattgggaaacctctgcccgaacccgcgccaatattaaggtgaaatgacggcccaagcctatacgcattgtcgcgtggggtgtttcctgttgaccggagcggccgagggggcatagtcggagccctcagccaactacttgggaaaacggcgccgatgctcacctacgccctggtcgccctgggaagcgccatcggaggcacgttgcgctactggctgtccatggtgatcgccgaggccagcgccggcacctttccctgggcaaccctggtgatcaacgtcgccggctcggctgccatcggactgttcgccaccctgacctcggtggacggccgggtgttcgtccccagcgagtggcggaccttcttcatggtgggcatctgcggcggcttcaccaccttttcatccttcagcctgcagaccctggccctggcccaggacggcgactggctggcggcggggctgaacgtcgtgggatcggtggccctctgcctgctggcggtgtggctgggccatgtggccgccacgatcatcaatcgataggagagcggccatgcgcattcccaaggacgccaccctgctccgcatcttcctgggcgaggccgatcgccgcgatggcctgcccctgtttgaagccatcgtccaggaggcccggcagaataatctggccggcgccaccgtcctgcgcgggcgcatggggttcggccattcgtcacggctgcacagttccaagattctggcgctgtccgaggacttgcccgtcgtggtggaaatcgtcgatgcgcccgacaagatcgacgcctttctccccatcctggacgttatggtgggggatcgtggcctgatctgcctggagcggattcaggtcctgcgctacggaccgaacaggtccgtataggcgatccggccgtcacggcttgattccgaatgattccacagagcggctggacaaattcacccgtgggtataagctgaacgtctaatgcgggagtcatggcacactggaatggtggggtcggcctcccgtttgggcatcgggggatgcgcatgaaaaaagtcctgatcgccgttggcgtcgtggtcatcctgatcatcggcgcccttgtggccctgccggcgctgattccggccgagcgcatccaaagcgagatcgtcgccggggtgaaaagcgccaccggtcgcgacctgtccatccagggcaagctctccgtgtcggcctttccctccctctcggtccaggtcggcaacgtcgccctggccaatcctcccggcttcaccaccaaggatctgatccgcctgggggccgtggatgtgcggctcaagctgatgccgctgctgggcggcaaggttgaggtggacagcttcgtcctggttgatccggtcatcgtcctggagacagaccgccagggcaagggcaactgggtgttcgacagcccgaccgccccggcccccgccgccgccaagccggcggacaagcccgccgacaaggccgcgtccgccgcctccaccggcggcctcaacgacatccgcctgggcgacgtgcggatcaccaatggcaagctgatccagatcgacggcaagaccggcgccaagcaggaggtgagcgacatcaacctccaggtggcgctgaaaagcctgacggacccgctgtcggccaagggcagtctggtctggaacgccaagaagatcgaactggccctgggcgtcaccagcctgaaggcgctgatggacggccagagcagcgcgctggaggtctccgtcgcttccgagccggtcaagcttggcctcaagggcaatgccaagggcggtgccgctccgggcgtggacggcacgctggaactcaccgtgccctccatccgcaacctcgccgcctgggccggctcgcccatcaccatggccggcaacggattgggaccgctatccatcaacggcaagctggccgccggaccgggccaggtcgccttcacccaggccgccatcgccatcgatgccatcaaggccaagggtgatgtcaccgtcaataccagcggcgccaagccggccatcaagggccggctggacgtggacatgctggacctcaatccctatctgccgccggaaggcgccccctccaagggcggcgacggcaaggcggcggcgggcagcggcggggcaccgccggccaaggcgcagcagggctggagcgacgatcccatcgacgcttcgggcctcaaggccgccgacgtggatttcgccctcacctgcggcggcatcctggtcaagaagatcaaagtgggcaaaagcgccgtcaagctggcgctgcacaacggcaagctggccgccgatctcaccgaactggccctctaccaggggtcgggcaagggccgcgtggccctggacggctcgcagccgggcgtcggtctcgacgcctcgttccagttgaagggcctgcaggccgaacccttcctcgccgacgccgccgataccgaccgcctgtcgggcaccggcaatttcgacgtcaccgtggcgggtcagggcaagacccagcgccagatcgtctcgtccctgaacggcaagggggcgctggcattcctcaacggcgccatcaagggcatcaatctggccgccatggcgcgcaacgtcaccagcgccttcaccggcggcgccaagtccacggaaaagactgactttgccgagctgggcgggaccttcaccatcgtcaagggcattctgaccaacaacgatctggcgctgaaatcgccgctgctgcgcgtcgagggcaagggcaccgtcgacctgccccaacgcagcgtcaattaccgcgtcgatcccaaggtggtcgccagcctggaaggccagggcggcggcaatgcggccggaatcgtcgtgccgatcctggtcagcggtccctgggacaacctctcctaccgccccgatctggaggctctgctcaagcagaacgtccagaacgtgggcaaagccgtcgaaggcctgatcccgggcgtcggcggcggcaagtcatcgggctcggcgcccaccgacggcttgaatcccatgaagcttttcggacgctaatcttctcaacacattcatgtattcaacggagaccaacaccatgaagttcctgcacattgccgccgccatcggcatgaccgccctgctgggcgcctgcgccactccctgggaagtggccgaggtcaatgagatcgaggcggcttcggcccccaccgccggctcggccttcaccaaggccctgttcagcgagtaccgggcctacgccatccaggaagccaaggtcgagtacgagtgggacgacgccgccatcttcgcccgcaagggcctgcgcgccgccaccggcgaagtcgtcgctccggccgagctgaccgagtgggcggtccccgaggcccgcgtcgccgagctggccgccgcccgtgcccgcctgatcggctatttcggcaatggcgcccgcgatcgcgttcccgccgccgccgccaaggcccaggtgatgttcgactgctgggtcgaggaagagcacgagggtgacaccaattccgattgccgcgccgccttcctgaaggtcgagcccgagctgcaggtcaaggccgccgccgtcgccccgaagatcgtcaaaaccttcatcgtctacttcgacttcaacaagtcgaccctgaccaaggaagcccagaagaccctgaaggaagtggccaccgccgccggccagatcaagcccgccagcatctacgtcgccggtcacaccgacaccgtcggcaagtcgggctataacgacaagctgtccaacgcccgcgccgccgcggtctccaagcagctggccaaggccggcatcaagtccatcgacgccaagtcgttcggcttcaccaagctggccgtgccgaccaaggccaacaccaaggaagccaagaaccgccgcgtcgagatctacttcgagaagtaagatcgaccgggcgttctgacgccaaagccccccttccccaacgggaaggggggtttttctttgggtactctggaaagaaaggaatgcgaagggactcgtcccttcgcgcatcccccttcccttgccagccccaaacgccctgctacacttggtggcaatgggcggaggggcacatggccgatttcttcatcagctacacgtatacggatctcgaatgggcccggtgggtcgacttcgtgttgcgcgaagccggctacgacaccgtcatccaggaatacgacttccggggcaatttcatcaccgagatggataaggcggtggacgagtgcgattacaccctggccctgctttccccgaaataccgcgcctccgtcaattgccagcgggaatggtcggcggcgctggccgccgatcccgacaagccgcagggaaagctgctgcccctgcgggtggtcgagatggaggtcaccggcctgctggggccgatcatctggcacgatctcgccaccgcccccaacgatcgtgacgccgaacgccgcctgttcgaggccatcaaggggaaggtccgtccctcgacccgtccggctttccccggcaggggacgcaacattccggcctttcccggcggtcgtcccgccatctccaacctgggcccgcgcaatccccatttcgtcggccgagtccagttgctggagcggttagaccgccagttgaaggagggcgcggtggcgctgaccgccctggccgggctggggggcatcatctccaacctgggcccgcgcaatccccatttcgtcggccgagtccagttgctggagcggttagaccgccagttgaaggagggcgcggtggcgctgaccgccctggccgggctggggggcatcggcaaaagccagacggcacagcactacgcccatagccgcaccgggctggagatcgtctggtggctgcgcgccgagcgcctggaaaccatgctgggcgatttggccgaactggcccggcgcctgggcgtggcacccgagggccacgacctgcaacagcgtgcccgcgccgccctggacgaactggcccgccgcgacagctggctgctggtctacgacaacgccgaggacgaagattccgtccgcgactggctgccccaaggcggcggcgcggtgatcatcacctcgcgcgagagccactggggacgcatcccgctgctggaagtggacaagctggcccgggccgaatccgtggaactgctgctcgatctgtcgggcgacaccgacacggccgccgccgccgccctggcccacgacctggatgacctgcccctggccctggaacaggccgccgccttcgccaaggtggcgggctggaccctggcccgctatggcgaggaattcacccaggcccacgccagactgctgcaacagggcaagccggtggattaccccgccaccgtcgccaccacctgggacatcagcgtccggcgggtggaggagcacaacccggcggcggcgcaactgctgacgctttgcgccttcctggccgccgacgacatcccgctggacctgctgcgccccgccgcccacaggctaccctcccccctggccgaggtgctggctgatccggtggataccgcccaggcggtggccgaactggcccgccaatccctggtcaaggccaaacacggcatgctgtccctgcaccggctggtgcaactggttcagcgcaaccgtctgagtgaagacgagtgcagggattggacggcgcgtgcgttttcggcggtgtatctggtttacgagttcaaggagaacgacctcaccacctgggaagcggcgggcctcttactgccccacgccgaggcggtcgccggacgggccgagacggccgaggtggagtggcgggcgacatcctggctgctggacaaggcgggagagtgcctgatcaaagacgggctatacgaacgcgccatcgacctccggcggcgcgccctctcccttgccgagaccaagctgcccgcagatgatccgccggtagcgaccctcctcaacaacttggccatcgcccattaccatgctgaacagtgggcggaggccctgccgctgttgcggcgcgccctggcgatctatgaagcccaatatggacctgaccgtcatgaggtggccgccacgctgggcaatctcgccatggtctatttgaaactcggcgacctgccggaggcccacaaattaaccgaacaggcgctgaccatcggcgaggcccatttcggcctcgaccaccccacggttgctgttcgcctcggcaattttgccaacagcctggacgatatgggtaagcccgccgaggccgagccattgcagcgccgcgccctggagatcctcatcgcccatttcggcgaggtccaccccttggtggcgggttcacgccacaacctcgccatgaccctgaccgaccttggccggttggaggaggcgcgggagatgatgggcaaggccctgtccatccgccaaaccctgctcgccgccgaccatccccttaccatccttgcccgcggccttctggccgagatcgacgcccgcatcgcccgacgcggcggggcgtcgtcctgatccgcccgatccggcggcatcaaggaacagggatgcgcgaagggacgagtcccttcgccctttcccttccttcagccgctcagcagctgaacagtacggggatggaggcgtgggccaggatgtggcgggtgccggcgccggccttgccagagaaggacagggtgcggcccacatggccgccgatgaccagcaggtcggcatcgatgtcgtaggcccgcgacagcagggagtccatgatgccgaggccctcggtattgacccgctcgccgtggacgggcaggccgtggacgcgcagatggtcgatgacgtcgacccggggcgtggtggaatccatgggggcgaagccgcgcaccgaggcgaccagcacctcgtcggcgccttccaccagggggaggcaatcgtgcagggcgcgtgccgcctgcttgcccgaacgccagccgatgaccaccttcttgcccagggggcgatgggtgtattccacgggcaccaccaggacggggcggccggaattgaggatgatctgctcgaccatggtctcgggcacgttcttgccgtaggcggcgggctgggagacgatcaccaggtccacgtagtggctgcagaacaccgcctcgcccagcagatcggtctcggcgccgtggacgatctgccaccagcgggtttcgaggccggcggtcgccgcctcgaaggcctggcgggcggcgtcggcctgggccagcaaggtgttgctgggatggcgggcgaccatggcggtggggctgatttccttgcgcgcgaacaggccggtcagccgcgcgccgaagcgctgcgcctgggccaccgccagggccagagtgccgctatccaccttgtcgccgtccagatggacgagaatgtccttgatgttcatgaccccaccctgtgtccggtatcgttgtcttttccggtcaggatagttcacccccggcggaggcgcacgtcaagcgaaattgcgcaaatcggtattggtttgcgtcttttatgactcgctccagccgcaccctttcaggaccgacagcatgtgctcggggaccggagcctcggcggcgatggggggcttgcccgcgtggaagggcaggacgatgcggcgcgaatgcagcatcagccggtcgccggccagggtgccggtgcctcggccatagatggaatcgcccaccagggggtggccgatggcggcgcaatgggcgcggatctgatgggtccgcccggtgagcggccggcattccagccaggaaagccgcccatccgatcccagcagccgccattgggtgaccgaggccaggccggtgcggtccacctccatgcgccagccgaacttcttttcgcgcttcttcagggcatagtcgatgacgccctggtcctctcgcggcttgcccaccaccacggcccagtaggtcttgtcggccagccccttggcgaacagctcgcccagcccggccagggccttggaggtccgccccagcaccagacagcccgaggtctcgcggtccaggcgatgggccagttccggccgccgcttgaggccgaaactgagcgcatcgaggtaaagcatcagatgctcgccccccttcggcccggcatgcaccgccagcccggccggcttgtcgatgatcagcacggccgggtcgcggtacagcaggcgcgcaagcagatccatgcgggtctagtccgccaccgccgccgcatccgcgtccgccgggccggcgacgtgaccatgggcgtggcgctcctgggcggcttcgctgacgccccggcgctgggccgccacgaaggtgtagatcaccggcagcacgaacagggtgaaggccgtgccgatgctcatgcccgccacgatcaccacggcgatggagaagcgtgacgccgctcccgccccgtgggcgaacagcagcgggatcaggcccgccaccatggccgccgtggtcatcaggatgggccgcaaccgaagaccggccgccaccatcaccgcctgggcgcggtcgagaccctcggcctcttggcgctcgcgcgccacctcgcagatcaggatgccgtgcttggtgatcaggccgatcagggtgacgaggcccacctgggtgtagatgttcatgctggccacgccgagagccagggggatcagggcgccgcagatggacagcggcaccgagaccatgatcaccagcggatcgcggaagctttcgaactgggccgacagcaccaggaagatgatgatcagggcgaagacgaaggtcatcgccagggcgttgccctcctgcacgtattgccgcgactggccggcgtaatccaccgtggtgccctggggaaggacttcctgggcgatggagcgcagcagttccagcgcctggcccagcgtcacgccgggcatgggaaaggcctggatggtcaccgagttcaactggttgaactggttgagcgacaccgggcgcaccgacgagcccaggctgaccagcgacgacagcggcaccgccccgcccgaggacgagcgcacgtgatagcggcccaactgggcggggtcgaggcggaattcccgcgggacctgggggatcacctgataggagcggccctggagattgaccagattgacgtaattgccgccggtcatggtgcccagggcgtcaccgatctgctgcatggagatgccgtaggccgccgccttgtcgcggtcgatgaccacctgggtctgggggctttcgatcttcagatcggcatcgatgaaggcgaacatgcccgaggcttgcgcccgcttcatcacctcgccctgaatctcgttgagctgctggtaatcgacgatggaggacagcacgaactgcaccggcaggccgtcgacacccggcaggggcggcggcgggaataccgaggccttgacccccgacacctcgttcagggcctgctggatggcggcggtcagcgccttggccgagagcttgcggtcctcccagggggtcagcaccgcaccgccgaatccctggctgatggcgcccatgccgttgatcaggaaggtctcgttggtctcggggaaggccttcagcttggcggaaatctggtgggaaaacgcctccatgaagtccgtattggccgaggccgggccgttataggcggtgaacaccacgccctggtcctcttccggcgccagttcggtgggcaccgccaggaacaggaagggcagcgaacccagcacgatcatggcgaagatcagggtggtcggccggtcggccagggaggccgccagccacacctcgtatttggcccgcacccggtcaaaggtgcggtcgatcagtgcggtcagccccttcttgtcgtcgtcgtgcttcaggatcttggaacacatcatgggcgacagggtcagggcgatgatgcccgacaccaccaccgacccggccagggtcagggcgaattccttgaacagggagccggtcagcccgcccatgaaggcgatgggggcatagacggcggccagggtgatggtcatggagatgaccggtccggcaatctcgcgcgtgcccaccagggcggcgcggaagggcgtcagcccctcctcgatatggcggtggacgttctccaccaccacgatggcgtcgtccaccaccaggccgatggccagaaccatggccagcagggtcagcaggttgatggaaaagccgagcgacagcagcagcaccgccacgccgatcagcgacagcggcacggtgaccaccggaatgaccaccgagcgcaccgagcccatgaagaagaagatcaccaccatgacgatgatggcggcttcggcgatggtcttggccacctcggtgatggcggcgtcgatgaacagggtggaatcataggcgatcttggcggtgaggccgggcggcaactgggcctgcagggcgggcagagccacttcgcgcacctcacggatcaccgacaggggattggcttcgggcgtggtgtagatgcccacgaagatggcgcgctcgtcaccggcgaacacgctcatgtcgtcgttttccggccccagttccacgccggccacatcaccgagccgcacgaggcgcgagccgtcatgcttgatcaccagctggcggaactcctcgacgcttttcaggtcggtggaggcctgggtgttgaccacgtcataggcgcccttggtagagcccgaggccgaggtgaagttgttgctggtcagggctgtcttcagatcgtccggccccatgccgtgctgggccagcttttccgggtcgagccagacgcgcatggagaatttctggccgccgtacagttccggattggcgacgccgggcacggcggccagcttgggctggaccacccgcatgacgtaatcggtgatctgctgctgggagaggcggtccgacgagaaggcgagataggccgaggcgaagctttggcccgtctccttcttgatgatggaatcgttgatgcccttgggcagcaggctcttgacctcggccaccttgctcatcaccccggtcatggcggtttccgggtcgtcgttgagccggatgaaggccttgacctcgctgacgccctggatagagcgcgacgtcaggtagttgatgccctcggccgtggccaccgccttctggatcggctgggtgacgaagccctggatcatgtcggcatcggcgccgggaaaggtggtggtgatggtgatgaccgtgttggtcatctcgggatactggcgcaccggcaggctcatcagggcgcgcaggccgatgaacaggatcagcaggctgaccaccgcggccagtaccggccgcttgatgaagatatcgaacatcactgcaccgtcccggcggccgccgtcttcaggggatcgctggccgccacgtgaatcagcgagccgtgctccagcttgacctgacccgaggtgaccaccacgtcgccggcggcgacgcccgacttgatgaccaccagaccgtccttgcgctcgcccaggctgaccacgacgcgctcggccttggagaccgtcttgccgtcggcaccggcttcctccttgaccacgaacaccgcgtcgccgtgcaggttgtaggccaccgccgagcccggaaccgtcaccaccggagcgccggcgggccgctcgatctcgatgcgggcgaacatgccgggacgcagccgcccctcggcgttgggaaagcgggcctgaaccgaaaccatgccggtcttggcatccaccagcggctcgatggcggccacctggccctcgaaggtcacgcccggccaggcgtcggtggtcatgcgcaccgtctggccgattcccagcagggaaagatccttctgcgacacggtgaagtcgcacagcatcagcgacagatcctgcagattgaccaccatctggcccggctggacatactggcccagatcgatcttgcgcacacccaggcggccgtcgaagggcgccgcgatggtcttcttggcgatctgggcctgcagcccgcccaccttggcctgcttgaccttgagttccgcctcggtcttttccagggctgcgacgctgaccgtatcggagcgcaccagcttcatattgcggtcatggctggtcttggccaggcccagttcggcctgggcgctgcgcaggtcgcccatctccacgtcggtgtccagttgcaccagcacctggcccctcttgacgtcctgtcccgactcgaagctgatggccttgaccagaccggccaccgagccggaaatgtcgacgccgttgaccgcctgcagcgtgcccaccgccggcaccaccacgcgccagtcgaccatctgggccttggcggtggtcaccgagatcaccggcttgggcatggtggcgaagaactgcttgatcatgtggttcttgaaggcgacgaagccgaagactcctccgaacacgatggcagagcccgccagcatgatgatcatccgtttggctttcatggcgtaggctccgttactgcagaaggtcgagggcgtgccgcttgaggcgctcggccccctcggcgtcgctgaggttgatccccatcaggcgctggaaatagacgccgtccatggcggtgcagatcagcccggcccgctgcaggtcgggactgtcgctcttgatgcgctccatccagcggtcgtacatagcctggatgggggcgaccaggtctggattaacggtgacggcggccagcagggcgccgcccaccggatcgaaggccgggccgttggggtcgaagcaggcgttcaccagggtccgggcccagcgatagggaccttccggctgatgctcgtaatgctcgcggttgagctgatcgcactggtcgatcagacgctggaccatgccgcggatcagatcgtccttgctcttgaaatgatagagaacgccgcccttgctgatgcccgcctccttggcggccgcgtccagggtcagcttggccaccccctggtcgcgcacgatggccatggcggaatcgatgatcttgtcgcgggtgctcattgcgaattcaggccccttactgtaccggctggacggtatagtaaagtgaactgatgagtccagtcgtacggacgcataggggggatgcggccggcgctattccgtttgggaagtggggaattgatgggtcacggcgcttggatcgggaacaactccacgtgcgtttcggcggtacggccgaaatacacggcccggcgaccggaaaaggacaccatgtagcccgcacagccggccgcccggactttcttgcaaaatccgacataggtgtagcccgccaccatcccctgtgcctcgcggatggcggcctgaacggcggccgtgtccagcgacggggcgattggcgtgtcatcccggtgggtggacagcacgacactgtcgccgtcgggacggtaataggtggcgcaggctcgccgaaagtcgacggcatagctctcgaaaccctcggccatcagcctctccacgatctgagggaaggtcatggcgccactttcggctccgtccagacaggcctgggccgtggcgatccggcttgcgtccatggtcatctcctctgcatggggtcagtcgacgggcgtggcggtcaggccaagccgcgccacggtgtccttcaggataagctccaaggcccggcgctcctcccgggacagatgagcgaaacacgcggcatcgttccggtcggccagggcggccaattggggaacgaattccgcccccctggcggtcaggctcagggtttgcgcccgccggtcgtcgaggctgggccgccgggcgaccaaattcttagcgatcagacgatcagcaagcttggtgacggcacccggcgtcagccccatccgcgccgccagccggccgggggacaaggggtcctggccatagagcatgcgcatcagcgcccattccgcgacggtcacctcctttgccgccagcatgcgggcaaaggaatgggagacgtggttggacacctgacgaagccagtagccaaggtgagcggtcaattccgagacggcgggcgacatgggcgactctcgatttaattgactaggaaactacatcattattatcttcctagtcaacaaatctgaagtcccgcaccgccccttgcggcaggacgggcgaaaagaccggggtctatgtacgcgcgcagggccgcgtcccttcgcgcatccctacttcttctgcctggccttggcgaaggcggcggcgaaggctccgccgccctcgtccgccttgggggccgccggctgacgctgctgggcctggggggccgggcgacgctcgtcgcggcggggcgcatcatccttgcgggctggggcgggctgggcgtccatgcgcatggacagggcgatgcggctccgcttgatgtccacttccagcaccttgaccttgaccagatcgccgggcttgaccacctcgtgggggtccttgacgaagcgatcggccagcaccgagatatggaccaggccatcctggtgcacgccgatatccacgaaggcgccgaaattggtgacgttggtcaccacgccctccaggatcatgccgggcttcaggtcgttcagggtctcgaccccttccttgaaggcggcggtcttgaactcggggcgcggatcgcggccgggcttttccagctctttcaggatgtccttgaccgtgggctcgccgaagcgctcgtcggtgaactccttggggtcgagggagcggatgaacgaggaatcgccgatcagcgccttgaccgggcggccggtggccttgacgatgcgctcgaccaccggataggcctcggggtgcaccgcagaggaatccagaggattgacgccgcccaccacccgcaggaagccggccgcctgttcgaaggccttggcgcccaggcgctccacctgcttcaaggcctcgcgcgaggcgaaggggccgaagcggtcgcggaattccaccacgttgcgggccacggtgggggaaagcccggccacccgggccagcagcggcgccgaggcggtattgacctcgacgcccacggcgttgacgcaatcctccaccacggcgtcgagggagcggcccagcttcacctgatccacgtcgtgctggtactggccgacgccgatggccttggggtcgatcttgaccagctcggccagcgggtcctgcaggcgccgggcgatggacaccgcgccgcgcagggagacgtcgagatcggggaattccttggcggccagttccgacgccgaatagaccgaggcgccggcctcgctgaccaccagcttttccagccccagatcggggtggcgcttcatcacgtcgatgaccaggcgatcggtctcgcgcgaggctgtgccgttgccgatggccaccagcttgatgccgtgcttgcgggccagatgggcgatggccgccaccgagccctgccagtcgttcctgggctggtggggatagatggtggcggtctccaccaccttgccggtggcgtcggtcaccgccaccttgacgccggtgcggatgccggggtcgaggccgatgcagttccgggctccggccggggcctgcagcagcagggcgcgcaggttgcgggcgaagacgttgatggcctcggcctcggccgcctcgcgcaggcggctcatcagctctaactccaaatgcagatgtatcttgatgcgccaggcccagcgcaccgtctcggccagccaggaatcggcgggacgcttcaggtcgcggacggaaaagcgccgggcgatgcgcgcctcgaactcgccggggccttgggaaaccgtgccgtccggccgtgccgcctcgtcgggagtcagcagtttcagattcagaacgttttcgttgcgcccccggaacagcgccagggcgcgatgggacggaatagccttgatggcctcgcggtagtcgaaatagtcggagaatttggcccccgcctcggacttgccctcggccaccgtcgagatcagcacaccgccatcccacagggcgtcgcgcaggttacccagcagttcggcatcctcggcgaagcgctccatcaggatctggcgcgccccgtccagggcggccttgacgtcggcgacgcccttctcggcatccacatagggctcggcggcctgctcgggaaccagggcgggatcggccagcagcgcgtcggccaggggctctagacccgcctcgcgggcgatctgggccttggtgcggcgcttgggcttgtagggcaggtacagatcttccagccgcgccttgctgtcggcctcgccgatctggcccgccaggtccggggtcagcttgccctgctcctcgatggagcgaagaatggccgcccggcggtcttccagttcgcgcagatagcccaggcgctcttccagattgcgcagctgggtgtcgtccaggccgtcggtggcctccttgcgatagcgggcgatgaacggcaccgtcgcgccttcgtccagcatctggaccgtcgccgccacctgcgagggcttgacccccagttcaagggcgatgcggttggtgatggcggccagggtcgcgacgggaagggacagggtcatgcttgctcacgctcggttgcgacaagaaggtggggtgtagccaaatttcggaccgctgtcacgaccggagatgtgcgacaacccttaaggcgccatacgcaatatcactaatgccatttgagggagtacggtgacggatcgtgacgccaaaatgaacgtgtgtgagaagaaaaaacgagttgtttcaagcgtttgacagatagctttccgatgattatctctccagaagcgacgtggcgtcgtaggtggaggcccccatgttcctatggaatatgtccctggaaaccggcatcgaagctgttgatcagggccgcaagcgcatgctgggcgccatggcggatttttttcaaggcatggacgatcccagtctcggtcaacagacgctggcggcccggaccggggcgattttcaatgccatgaaggcggcctttgccgccgaaaacgcctacctgatcgagcgagatgcccccgacctggaacggcaccaagccaaccacgccgccctctcggccgccttcgtcgatctgtgccgcaagctgattcccaagatcaagactcacaagcaggcacagcaatgctgcctggaaatctaccagttggtcgatgaggccatcttccaccacatcaccaaggaagtggccagttaccgcaccttggcccgcacgccggtcaagaaggcggggtaggcgttttctcgtccgcctcgtcgctctcgaccatcaggcggattttggccgccatctccgcctccatgcgggcttccctttcggcctcgctttcggcatggatttggggcgccgaggtgatttcagccaacggcatcgggtcccgctgcacgtccaggcggaaggatccccccatcatccgggacacttcgtccagggacagcggttcgtgaaaccggcaccccgccagcccaccaccggcccacatcaccgtcgccggcatcacggacaagtcatcgcggatgatgatatcgcagggaacgggcagaatcgccgccatggccagttccgcatcgtcgaaacgcagcttcaagccaccgcgggatacgtccagcagaacggcacggctttcccggcccatcagggtgcagcgacattccgcactgctgcgcaggcgggtaaattcgcgccggttgccatgctgcccctggtcatcggatgccatgaccatgccccataagcgtttcaccggcccccatgatatgtcacgaaatcggcaatgaatagccggaacgcggcgcggccccttccgtcatgccgccggcggcggccgttccgcctctggctcgggcggcggcaccagttgcaggcggaaatgtccggtcatcacgcgcaccacgtcatccagggacaggtgctgatagaagcgacagccggccagcccagcactggcccacatgatggtcgcatgcatcttcgaatactggtcggcgacgaccatgtcgcgcggcagcggggtcatggcggccatggcggcatcagcgaggtcgaatcgcagcttgaacccgccgcgggacgcatccagcaaataagcacggctttccatgccatcgagcacaaaggtgcactcggtaccgcatcgctgcctgggaaacagccttttgttgtcctcggccgcgcctttatcgagtgccatggcaccctcccgcctatcctcttaaccccttgatattatggcgcacggattaataagtttccataaacaaagcccccggctccccccttggcaggaagggaaccgggggcccgatgtcgtctcaggctattagaacttcacgaccagcgaggtctcgcccagcagccaggtcttgttcatgggcaggttggcattgctgaagctgttggcgctcaggttctgcttgtagccatgcccggccttggcggcaccgaaggcggcggacaaggcgacgttgtcgctgatggcccactcggcggccacatcgatttcacgcgccagatcgtccgaggtgacggcggtgcccaactgctgcttggcatcgtacttgtagttaaaggccagcacgctgagcttcagatcgtcacggggattcacgctgaaggtcagctggtgaatgttgacgttggagttggagatcacgtagttgccgacgatctcgccgatgaaccaagtgccgaagccgcgggtgatggcgttgtagaagaagggatcataggcctccttcttgtcgtcgccggggttcttgtcgcccgagaaatgggcatagcggtaggacagcttgggggtccacatcacgtccgacaattggtagcccggctcgatgtagtaggcgttggcgtcgaccttggcgttggccgtgttgttattctccttcacggcattgccgtacagggagaagtccggcaggaacggcagcggattgccgccgacgtggaaggagaacacggtcatgccgtcacgggccgacgacagggtgttggtgacggtggagttggtgatgccgctatggccgaatccatagacgccacggctgtcggccgaggccacccggaagacggtcatgccgccgtaccacttgcggtcggcatagttggaggcgccgtcgggagcgggcttgccctcgacctgatcgacattgccgaacagttcgatattgccaccaataaccttggtcttggcgttctcgtacaggcccggcgacatcacgctgttggaggcgttgttctgcaggtagaacacgtcaccacgcacattgcccgaagacagcttggccacgccggtctgggcgaaggcggtccgggactgggtccagaacatgccgcgcgagccgatgttgttggtgccgttgctgatcaggaagccatcggcgactcggaagctctgacggccgcccgacaggtccaggccattctcgtccaggcccaggccctccagggtcttgcccgacttccagccggcgtacaggttctccagctcgagcatccactggtggccgtaggtagttgaaatcagcgaaggctcgccatggccgccggtcatggtgaactggccgctgacatcgccgtagaacgtgccataagcctcggtctcgtaggaggccttcagctcggggtgcaggaacgtctcggtccagttgttgtgaccggtgacgcgcttgcccggcgagccggcattgttgttgtacgaaccgacaccgaactgagagcccggggtggtgaacagggtaacgccgccggtgaaggcgccgtcaatcttcaggccaccctgctcgtagagcgagaaatcggcggaagccggcgaggccgcaaggcccagaaccgccgagagaatcgcgcccgaaatcagggaacggctgcgaagatcgtgtccaaacatatttgacccccttggtgatctgtcagagttgccgggaataacgcaaccctcgtgccaaaactcgtttgcccaaaacgcagggtcttcgcgcttttccgcgccggccgactgctgaattcgtaagcaacaccgtcatacatgagtgattattgggcaggcaacccaatttcagggtcataccgctgacggcgtgagcaatgcgccgcaccgttgccaaaaagcaacgcttgtcgcaaacacgaccatggaatgggaaggaaatggccaccgcccggccagggccgggcggtggcatggcgcgacctcacccgacgtgagtgtggttctccacgtaaacgtgggtatcgccgttggagtactgggtatagctgtcgtgctgcccgttgaccgtcagttcggcggtgccattggcctgccagccgctgcccgccagggtgacgctgttcccgccgatgaccaccagggcattgcccgtgccggtcaccgcattggtgccattcagcatggattgcaagtgggcgagatccagcaccgcattgttgttgttggcgtggctgaggtccaggacgtcaaagttctgtaccgcgttgttccacagccctgtcagatcgaaggcctgattgttgaggttctcccactgcaaggtgttgccgccgccggcgccgccatccaggaagtggaagttcatgtcggaaacaccgatggtgttgtagctgccgtggccggcatagacgtcggcgccgccacccagatgcaccatctcgttctggccgaggccgatgacgtaatcagccgtcgctccgccgttataggtcgaattgccgttgacggtggtcgcggcatgggcggtcaccgacaggctggtgccgttgagggtcggatcccagatccagccggtgccgctgtcgatgccgtgaatgacctcgaaagcgcccgacaggccgcccgtcccccaggtcagcagcgtcgccgtgggattgccgctgatggtgccgtggctgtagatgtccagggtgccgtccagggtcaggctgccgctgacattcatgcggtcgaagctgccgttccagtaatccagcaccagatgcgagctttcggccaggctcaggctgcccgtcacccccaacgtgccggccgatgaggaatcgccgggattgatataaccgtgattgatgaaatccgcatcggtggcgttgatggtgccgctgccggcgatcttgcccagattgtcgatcagggcatggcttgtggcggaggtgtcgctgacggtcagcatatggttgttgctgagggtcagcgtcgcatggttgtcgaaggcatccgccaccagattgagggcgtggccgacattcacctcgccgtaattgctgaagctggtcgccgcgatggtgccggcgccgttgaatccgcccacctcgatgctgccgtggttggtcagcgcgtcggcgaccatcagggaggtaccgacgaacccgctgccaccggtcatctggatgtcgccgtaattgttgaaggcatgggccagatgcacgctggcactgacggaatcggtgccgacggtcaggttggaatccatgtacaacacggcggcggcggcgacctccagataggagccgatgtaatccgcccccttcatgatgaagcttcccccctgcacccgcatggtgccggtcccgctgagcgaggtcgaggtcatggcaccgccgttatagacggcaagtgtgttgccgccgatccccaccgtgccggacatgacggccgcaccggaaataccaaggtatccgctgcccgccaggctgccgcccgtgctcaggtcaaagccgccgaaatcggacaggatggcaccgctggccagcgacagcacgccgccggcgacattgagctgcgacggcccgtcgagccgcccctccaggccgagggccagcgtcccgccgctcagattcagcgtcgcgccggaaagtgacaggccggcgacggaatcgctgccggaaaggtgatcgaccgtggcgttgccgatcaccgccctggcgtccgaatccgggaccagcgtggtgttccagcttgccgccgttccccaggtccccgaggcgccgcccgcccaggtccggttgtggtcatagacggcgatatgctcgatgccgccgatagtggtggtcacgccgtcccccaccgaccaggtgaagctgtcccagccgctatagccggcggtgccggtataggtgtaggcgccggtggcggcatcggtgaccgtcgccgtgccatggctgggattgccggtcttggtaaaggttagctgaccaccctcgggatcggtcgccagcagcatgccgttatagacggccccggctacggattccccgatatcaccgccggtgatctccggggccagattggccggactcaccgtgaccgccatggtcttggacacggtgatcgagccgttggaaaggtcggtgacggtcaggttgatgttttcgccggtcgacgcgggatcggactggtaaacaacctccatcagcgcagcattgatgcgatcgaggctcccggtaaataccatgctgtggctgccattgctgccggcggtgaaagagattccccccgtggtatggagactgagactgccaattccgaccgtcagggcgaccgagtattggtcgccgcccagtgcaccgacctcgtcgaccacctgaaggttgagggtctcgctgccgttcttgaccacggagaagtcggcgccccccacgatggccggggcatcgcgtaccgagcgcactccgatgcccaccgtgccgtaggtcaggttgccgctgccatcgttgatggccaccacgaagtaatccgagccgaagtaattggcgtccggggtatagctgtagccgctggccccggcggacatggagccgccggtcaggaacaccgagccggccgacaaggtggtggtgcccagcaccgtggtgcccaccagggacagggtgccgtgctgcggcccctgggcgacggtcgcccaggtgggctggctgtaattgaggtgatccacgtcgaacagcccggcccgcaactcggtatcctcgcgggtgacgacggcgtcatcgaacagagacgccttggctccggtcaggctgaccgccgtgacaatggcacttccattgccgctgctgtcgatcgcaaagccgcccgatatgtcgtcaagacgccaattgccgaccagcttgtcgtcttcgccgttcacacgggtggtcatgtaggacgagatctcgctggccgtccgcgcatccttccacacccggacatcggacatctggccatcgaaatagctgccgctcacattggcatcatggccgatttcaaaattgctccacgtcgacaaccgactcccgataaacgccgaagaggtgccgacgctctggccgttgacgtagagcgtcgccacatcgttgtgcacgacgaccgccacgtggctccacaagccgaggctggccgagggaccggacaaggtcaggccttgcgacgccacgttggagccggcattgccctgcatggagaacaccagctggccgttggcgatttccaggttgaacaggttgacggtattcccgcccagcgaggaggtggccgacacaatgctctggtgggcggtggcggtgtcgggacggatccaggcctccagggtgaagtccccggagtaatccatcttgctgttgccgccagcaatgacactcgtcgaaccgttgaagtccgccaccttgcccatggtgttgacgttcaccggcgcggcgcccgtcccgaacgtccaatcggccgccagggtggaggtgctgacctcgttgccgcccagggtggcggccgactgaatctgggtctgggtcagcgccgacttccacaccgccatgtccgagatttcgccgttaaaggccatctgggtccattggtagttcagattgccgatcaccgcggcgccggcgccgatattcagattctgggacagggtggccgccccgtccggaccgccatcgatgtacaggacggcgtggccggcgccgtcataggtcaccgccacatggtgccaggcgccgtcattcaccgaagcggtggattgcggtcccgtgacgctttggccgtcgaagtgaagcttgccgttctccacgtagaagcacgcggtctgtcccacgccatcggcgccgttgtcgaagatgtcgccgcgtaccgtgacacccgacccgacccggatccaggccgcataggtgaaggccccggtgccggtggccagatcggattggttggcaacgttgattccggtggaagccgacagctgcaccgccgtccggccgccgatcgtcgccagattcgcaccgccgcccggcagggtcagggaatggccgttgccgctgaaatcgttcagtccggtgctgaccgccagggtcagatcgtgaccgtaactcgaattatccagcagcacgccggtggagttggcgttgtagacccggtccatgttccactcggcgatcagatgatcggaggaaagctcctctgtccggtgccagttcttccagatctccagcggggtgcggacatcgtcgaacaggcgcacctgatccagttgccccacatagctgccgccggcggcgggcgtgccgcccacatagaaattgccgctgccggaataatcgctggctgccgcggaattgccgaccgccacgccatcgcgatagagagtcaaggtgttggacaccgcgtcataggtgccggcccaatggtgccaggcccccgtatcggcgctggcgggataggtcaccgccgttccgccgctgcgaccgtccagcgagaagcggagattgcccgaagcgtcgaagccgacgaacagatccgttccagagccggccgttccctggctcagcagggtctggccgttgacatagccggccgccttgttggcccagaactcccaactaaacgacttgttggacagcatcacggcagtggacgaggcatagccggttccgtcgaattgcagcgacccgcccgccgcccccgaaccgacgaactccaccgggctttccgtgcggatggacagcagcttggtggtggtattgccgtcaccgatgccggtggccaccacattgaagctgtcgacgccgtaccagccggtattgggcgtgtaggtgaaggtgccgtcggtgttgaccaccagagtgccgtgggtgggcgacgtccccgccgtccagttgaccacgccgccggagctgtccggcgcgatggccgccagggtgccgtgatagggaacgcccgcctgggcgacgaccacatcgtcatagaggggcgcgtcgttgtggatcacggtgagggcgccggtcacggagccgtcgtgattgccgatggtggcgtcctgcaccacggcggccaccggggcttcgtccaggcgccaatagccgcccagggcggtctcggctccggtctgctccatgttcatggccgagaccacctgcacctgcgacagggcggtggtccagattcgcgcctcggccatgtcgccgacgaattgcggcgtggacgtgctgtacgaggtggccagcttgaccgcaccggcgatgttgtagtcgccgataacgccagtgccgtccagggtcccgtccacatagattctgtaggccgccatggtggcgtcgatattgttcaaggtcacggccacatggtgccacaggccgtcggccaccacgccgttgcccgcgacgggtccggcgtcgccagccgtcgtcagatgaatcttcccgtcgacgccggaatagatccacagcccctgaccggtgctggtggtcccggccgtaaagatcatctgcgcctgcgaggtatcggaggtccgaatccacgcctcgaaggtcagcgggccgttgccctgaccgaccgaggagccgagattgatggcggccgagccgttgaaatgcagggccgtctcggggacgacggccatcaccgccgggctggaactgaccgagatggtgcccgagaccgaggtcagcgacccgtagacggtaccgttcagggccccgtgggcatcgatcaccgtcgcggcggcgctggcctcgttgaggttccaggcggccagcaggttgctttcgttgccggccggctcgttccgcatggtctggacgatctgggtattgctcaggccgccgttccacacctgcacgtcggcgatatcgccggtgaagaaattgtcggtggcgtgcgcggcgccgatctgggcgccggccgagatggtcaggcccgaaatggagctgttccagccggattggacggtcgtgctctccagcacgccatccacatacagcttcagggtattggcggcggagtccacggcataggtgacgtagtgccactggccgtcggcgatgttggtggtacccagataggacttgccggtggtgccgttggtggtcacctccgccgccagcttgccgtcatagacggccatctgcgcccaagccgtcgcgccggggctgtaggtggagaagatgccgccatccaagccggcggcattgtccgtggtccggatccaggcggaaaccgtatggctggtcaggctgatgggcgaggcggtcttgacgtaatccgtggcgccgtcgaacgtggctccggtgatgggcatcacgccgctggcgacgggcagcacgaagtcgtggccgtggcccgacaggtccgtggccccgccggcaccgttccagtaaccgaccagacccgattcggtgccgtccagcacctgattgtagctggacgccatatcatgggcattgcggccgtagctccacaggcggacatcgctgatggcaccctcgaagccgttcaccgcaacactgttggacaccgactggccgacccacaggtcggcattggacgacagcgagtaattgctgaaggtgtggctgcccgacgccacggcctcgccgttgacgaacagggtgatggtgtcgcccgagcgggtcaccgccacatgcgcccactggtcggcggccagggcgctggacgcctgcagggtataggcgggactggcggaactgtccgccccgacgaactgcagatggccccccaccagttccaggcggatctgggcggtgcccagggaatcgccgaactgcttggacagaatggtggcgtggcccagcagggcggcggccgtcggctcgatccaggcctccatggtgaaatcgttgccgccgaaataggccagctggttggcgttggtcacaaccgcatggttgctgccgtccaggaccagttgccccatatgctgggtggcgcccagaatctcggtgggatcgtcgacgcgcaccgccaccagcttgctggacgatacgccgttggcggtcgccgtcagggtaaagctgtccatcccctcgtagccggtattgggggtatagacgaagctgccgtcggaatgcaccaccagggtgccgtgggcggtcaggctgcccgaggtcagacccgtagcgctgtagctgagcgtcgccccggtggcgtcatgggcgaccagcatgccgtgatactgcccgttgcgtgccacgtccacgccatcattgaagacgttcaggccgctggcggcggtctgcaccacattggtcacgccggccggcaggagcaggtcgtaaccattgcccgtggcatcggtcagatcggtcccgacccaggcggccagaagcccttcgtgatcggcattattaccgggcatggaatcatggacattctgggcatcgcgctcgacgctccacagccgcacgtcagcgatctggccgttgaaggcggtcgaggaatccaggccggtgccggccagatcgctgcgtgcgccgatggtcaggtcgtaggcgttggagatatcggcatccagggccgagacgctcttcaccgccaccccattgatgtacaaggtgtattggtcgccaccgcgagtcaccgcgatgtggctccaggtgtcgagggtgacactgcccgcctgcaggatcacggcaccgttcagccgcagggtcgggacccctccgctgagataaagcgccatgcccggctcggtcgagcccgccccctccttggcgacgatcatatgggtgccggacagcgaggtggtcggattgatccaggcttccagggtgaagtcgtccgcccccggatcgagaacatcgcccgccgacaggtacttgctgctgccgtcgaagctgaacgcctgggtttgcttgacgctgaccgccagatcggcatgatccgtggtggcccaggtggcagccgagctgaaggtcccgttatgcaggccagtcaggtcataggcggtggtgcccgtgccctcgtccagcttccagtaacccgccagcccgtattcatggcccgacagattgccgttctggtcggcgccgatctcggaaagcccacgggcttcgttccacagccggacctcggcgatctggccctggaaatgggtggtggaggccaaggccccgctcagattggtctggtcgaagccggccccgatcaccgtctcgccggtatgggcggcacccgagatattattgacggcgggaacgatgctggtggtgctgttggcgccattgccgtcgctgaagtgggtgtagcgcaccccgtcgaccaccaccgaccaggcgccgttgtcattgaccagggcgatgtcggtccactggttggcggcgacgagaatatcctgatgattggcgttctggaccacggcggctccgacgccattgccctgaatgacgatccgcccgctgttgtcgagcagcagggcatagcccgagctgccccagtcgccgttgctgaagatgacgccgccgtcaccgggcgaggtgccggcccaattgatcttcgcctcgacggtgaagtgggtgacgttggtggaggcattggccccggccagctcgacggcctgggtgtcgccgaacaccgccgcccgcaggggcggggtccccacatggctgccgctgcccaactgcatgtaggcatcgtaattggtgtcgttattgctgccgttgccatggtcggcatcgaaggtccaatggccgatcaacccggcccccgtccccgttcccaggccgtcgatatccccggcctcgatctggtccgcgctcagcttggtgttccagatcttgaggttgtcgaacatgcccttggtgaagaagctgctgttcaactccgcgccgagggtcatggtgttcagcgacgacatgacgctggccgtacccgaggtatccgtcaccgtggccgacagcgagccgtccaggtagatcttggccgtgccgtgatcataggtgaccgccacatggtgccaggacgacgaggtgatggtggacacccccgggaactgggagaatccggcgcccgacgcgtcccggtcgacatagaggcccagttccccggaggcgctcaccgtcgccttcagcatggcattggcgcccacgcccaggctgaacagggtctgggcaaggttggcgttgccgagattgacgtcgaactcgacgctgagctggccgccggcgaattcctcgcccggcaggtagatgctggccgccttggaggtgccgttggcgaacagcaccgaggtccgttcggtcgccccggccacggtgatcgggttggccacgtccaccgtgtagctcttggtgctgctgctggtgccgtcgctcagttgcagggtgaaggtatcggaccccacatagccgctggtcggcgtataggtgaaggcgccgttggcccccaggctgagggtgccgtgggccggggccgtccccgtctgactcagggtgaggccgctgccctcctggtcgaagatggataccgtgccgctgatggcgtgtccggcataggtgctgacgtggtcgctgcccaccggagccgaaccatagggccccaccgaagccgtgacgttgcccgtcgccgtggcgtccggcccggccatgttgaccacctggccttcgctcatggtccaggcgccgatcagaccggcctgggagttccaggagaccggcgccatgtcggccaggatgttctgggaggtgcgggcggtgttccacacccgcacgtcggcgatctcgcccgtgaagttctgggcggcggtcccaggggccgccgaattgcccagatagaccgggccgctcaggttgtaggcgttgatggtggccgtgccatccagctggccgtccacataataggtgacggtcccattgccgttgacgacgccggccacatggtgccattgcccgttggccacgttggcggtgcccagggtgatcgcgccgttctgcgactgtccaattcccagtttgccgttggcggcgacatagagggacatccccgtattggcgccgtcctggccgatatagacgatggtctggttggtggccgagctggtcttgatccaggcctcgaaggtcaacggccccgagccctgcccgatggtgccgccaaaggccacggcggcggatgaggagccgttgaaatgcatggcctgcccatccgtgggcgagggcatggaattgccgatgggaatcaggctggggccgttggcgttgagcgacgagaccggctcggtgcccgcaatgttgttgaagttccaggcgccgaccagtccggtctcggccccggtgggctccaggcccttgccgttgacgatctgggcgccggtgcgggccacgttccagacgcgcacgtcgtcgatctggccgttgaaggccgtgttggtgtcgacggtgccggtcccgccatagtgcatggccccgatcatcaggtcggtggccgagggctgggcggaaacggtgcccaccgacacggtgtcgatctgctgattgtcggcatagagcttgtagacgccgccttcgcgcaccacggccacgtggtgccacgcgccgtcattatagctgctggcgctttgcagcgaccacatggcccccgaataggtgtcgggcgacaggaaggtcagcttgccgtccaccagggccagggcgaaggtcgtgcccacgttgccggttgcggtggtgccctggccgatgatgatccgggtgcccgtcgtggtgtcgcgggtgttgatccaggcctccagcgagaaatcgcccaaggtggaggacaaggacgatgtcgcggcgaagccggtgccgccgttcaggtagacggcgctgttgttggccgacaggccgcccagcacgggtgcatggccggggctctgcaccaccagcttggcgaccgccggcgtggaggtcaggctgccgtcgctgacggtgtacttgatggtgtcggtgccgtagaagccgtaatccggcgtataggtgaaggcgccgttggtgcccagggtcagcacgccgtggctaggttggccactgatggtgccggtgttgtacagggcataggtcagcgcgccgccttccacgtcgctgccggtcagggtgccgctcagggtcccgtcggtattcagcgtgaaggtcggggccgcgcgctcggagaaggtataggcgacattgccgccgctcgtgctcatcagcccgttgacgctgccatccaccggattggtctgcaggccgtcgaagcgccagtagccggacaggccggcctcgtaaccatgcagcgtggcgctcatattggcggcgatttccgcctgggtgcgcacgccgtgccacacccgcacgtcgtccagcaggccgttcagggcattgcccgtggtgccgatggacgcgcccaggcccagcgtgccggtatcggttaccgccaggggcgcggtcgcgatggtgccgctggcgtaggacgctccgtccagatacagggtgacggcgcccgagctgctgatgctggccgccacatggtgccaagttcccgtgaaggtggcgggcgtaccagccagcgtcacctcggcgccaccgaccaccaccgccagggtgaaggttcccgggctgcccgacacttccttgacgaacaggccgtattcgacgctgccgccggtggtgccgcgggcgaccacggcgtgaagctggccgctggtctcggaggccaagggcttgacccaggcttccagggtcacggcatcggcgaaggccagcttgcccatgctgtcgttgaccgtcaccgtgctggcggtgctgccggtggcatagagagcatagcccgaccccgccccggccaccggggcctgattgaccggctgcacggcgatggaaacggtctggagcgccgacagggtctgaccgtcgctcaactgcacctggaacgagtccgacgtgtgggtcgagccgtcgttgaaataccgcagccccatggtgccgcccatgttgaggtcggacgcattgacggcatcccccaccgccagcacccggccattgatcaccagggcgccgtaatcgggcaggtcggaaatgatgtagctgagctggttggcgaaggcgctctcggtatcggtgccctgcaaccccgaggccccgcccatgatgctggtgaccgagccctgggacgtaatgaaggcggtgcccacggtcagagtcggcccggtattgctgacacccaccgtaaacgacatggtgttcatgccggtcatcgtgccgccgatgccgtcgctcagggtgaagttgaaagcatcgggacccgtggtgcccgccgccacgaacttgatgatgtcggcggcgacatcggcctgggtgaaggtcgccccggtacccagcaccgtggtccccttcatcagggtgccctgatgggccagggaaccgaccgtgtagaccagtttggaatcgcccacctgaatactgggattgggattcagataggcctcgttcagggtaatggtccccgactgagctaccgacagggtcggcagcgccagggcgatgccatgggcgtcatagcccatgttggccgtgaaggactgagccaccacatggccctggccgtcatcgacgttcacggtgaaggtgtcggcgcccacatagccggtatcggcctggtagttcagactggaccccgtcacgctgaccgtgccgtgcgccgtccgggtcgagcccgacagcgaatatgtcagcatatcgctgatatcgccgtcagtagccatcaaggtgccgctgaccatgctgccattggccaccgagaacgaggtcacggtggaggtcccggtcatcaggccctgccatacgggcacgtcctggacggaggtgatggtcagcgtgccggtggcctgggacgtggaataggcgctataggccgaactgccgacattggtgttgaccacggtgccgctggtggcgccatcggtgccgtcccaagcccggaagtctaggaaaacgttgccgttgaaattgtcgtggggccagaagcggaccttggcgctggccgccaggaccagggcattgaccgagttcacgttggtgtcgatatcgacccagccaccgccgccgttcaggttgaactgccacttgccggaggtcgaattggcattggtgacggcgatgcccatgccgcccgccacgatggaagtgtccacgtaatgcccagccaccagatcggacaccagggtcccggtattggccgcttcggagacatcctcgacgatggtcttgagcaccggcggaccgctcaccgagacggagatgttgtccagcatcgaggcgtcggcctcggcatgatacaggatgccgttccacaatgaggcgttctgggccgtggtgccggtccacagcagattggcgttgaggttctgcagcccggtgacctgcgtccaggcgcccgagttggtcagatccttgtagtagaggctgatggagccctgcccaccataggcgttggtatccagcacgatctggaaccgctcccacgccccggtcaggttgaggctggcgacctgagtcgaaccatcggccaggcgcaggatggcctgctggttgaccagattgtattcaaccccaatggcgccctcgttggcgtcgagggtcgtgaggtggttcgaagatgtcgccaggatattgccgtcgccgtccagatcggcgccgatccgcatgaaactgccccaataggtgggcgtaaagtcgtattcgagggtcagagtcccgccgttgaccagggtcggaatgacgaatccgccacccgacaaacgggaaatctccacatcctgattgccgccgatgagcgcattggtgaaggccttcgaccccacataggcgcccgaggacgataccgtggcgatggcgttgtcggtggcgcgattgctcacccagccgtcctggccaccgatagttccggcattcagggcgttgaagtcatagctggccgtcagcgtgccagcctgggtcagggccggagcgtcattgatatgcacgacgacggtgcgatcggtggtgccgccgaatccgtcgctggtccgcagcgtgagggtctcgctgccgccgaagccggtgttgccggtgtagctgaccatgcccgagccgttgacggtggccgtgccgtgggcggtcaggctgccgccgacgatggaatagctcagactgtcgccatcggggtcggtggtcgcggcgctctggctgagggtcatgccatagctgccctcgagcaggagtgtcccgcccgagaccgggctctgattgaacaccccggaattgctcaccgcgaccgaaatggtctgagtggtgatgccgccatggccgtcatcggcctgaacgacgaacttgtcgtgcccggtaaaggcgggatcgggatcatagacccaccggccggtattcgtattgagcaggaccgtgccatgctggggcgccagcgccccggtgccgacggtcagggtcagcggcagcggcgagctgaacagcagccggccctcgatattttggtccatcatggcgacgcggtcgtcggcccagaccggcaggccacccgtggcgctgagggtggcgtcgcgggcatagctcgacgaatccgtcgccacggtccccgtgccctggcccagagtccagttggcggccagcgcgctccaatcgggatcgctggaggtgatgacgcgatgggcgttcgccgcgatctcggcgctgctgcgcaccgtgttccagagccggacatcggcgatttcgccccggaagccctcggtcccgccgtccccggcatggccgatgatggtggtgccgggataggcgttgccggaaatctggctgactccgagcgtgccgttggggaagctgtagctggtgccgtcgatatcgacgctgaacaccccgctggagcgggtcagggccacatgctgccactgcccggcggtcaggatggcggtcgacgaaacagtcacggtgttgctgccggccatgacgccgaggtggccgctggcgctgtccacgtacaggccataaccgctgtacgaggcattgccgttataggcgatgaactgggcgccgccgctgttggtgccgtcccacttgacccaggcctccagggtcacgttgtcgatggccgtgctgacattggtggtggtgtggatgttgttggcgccgctgaagcggacggccgccgtctcggcgaccacggtgggagccggcgcgacatagaggctcgaagccccggtgatgtcggattgggccggcgcggtggtcacgccggccagcttgatcacggttccgttgagggtcgagccgcccaccgccagccagccatcggtgccgtcggtgaagaagccgaccacgttctggccaaggctggagaccatggcggccgaattctcgaccgatcccatccaggcgatgctgggggcataggccagcccgccggccgccgacaggtccacatggtcaagacccgtggcgaaatcggtgatcaccgccggagcggcctgggtggacacagttccggcgctgaagacgaaagtgtcggcgccggcattgccagtcagcacgtcgccgccggccccggcaatcagggtatcgttggccatgccgccgatcagggtctgcaccgcggaatcggccagagcactcagcgtcacattggccgtggacagatgggcgtccacggtggtgatgcccgagcccgaggccagcggccccatggtcagcgacagaggcgacccagacacgcccagcatcagggtctcgacgttccccacattggtgaaggcggaatcaaccaccactccacccgaggtgaagttcaggctgaggatgtccttgcccgccccgccattcaccgaatcggcgctgctgatatcggacagaatgaaggtgtcgttgccggtaccgcccgtcaaggtgtcggagcccgcgccgccgttcaaggtgacgccgccgccgctggtggtggtgatgatgtcgttgccggccccgccgtcgacggaggcgatgccgtcgccgacattgagggtatcggccgccgacgtcccggtcagaaccacgctgtcatagctgaggtcgatgacctggcggaatacgtcgtcgcccgacgtccccgttcccacataggtgacgaccacgtcgccgttggccagggtcgcaatctgcggctgcgtatcgccggtatagccggtggcggagatctggaattccgtgccgatcttgccgccggaggcatcgaaccgctggccccaatggctgtggggaacggcaccgcccgcgctctgctcccacacggccaggaagccgccatccggcagcgcggtgacggcggggtagccgtgccagatgccgttcgtgttgctgacctggaattcggcattggtcaatggcgtgccgttggcgccgtagacccgcccatacaccccgtaattggcgccgtcttggccggaactgtgccaggtggcgacgaaacctccgccggaaagggcggcaatggatacaccggactggtcacccgtggtgaagctgttgagctggaattccgccgacatatttccggaggcgtcgatcttccggccaaagaccccccagctgttggcgtcattggagtgccagaccgccaccaccgagccatcggccaaagcgcagaggccaccgagcggttcgccggtcaccacggtggaaagctggacctggttgccgacggcgactccggcggcgttgtagcgctggccgaacgtgtagtggctgccgaggaaggtggtgccggaatactcgctttgccaggcgacgaagaagccgccatccgacgttgcagtgaccaccggccaggcctggtaaccaagcgtggtgctgacgctgccgttggcggtcaccaggaattcggtgcccggcgtgccgctggtgggataatcggccgggaacacccgtccgtagacgccccaatcgggattgccggcctgcccgttgctgtgccagaccgcgacgatgcggccatcggccagttgcgccagttgcgccgcccattgctcgccggcgacggtgccgttgaccacgaactcggcgccgaccttgttgccggcggcgttgtagcgctgggcgatattgccccaattgccgaccgcatcctgatccagggattgccagctgaccagatagccgccatcggccaaggccgtgatggcattcggcgcctggttgccggcatccatcacgttgacctgtgtggccgttccgaccgtggcgaccggcgacagggagctgccgctcagagtcagagtccggtcggcgaagaccagggtctcgacaccggccagggaatcggtgccgtcattgccgtcgacggtattggtgtcctggacgacgacgccaccactggcggcgcggatgctgtacccggcggcgttgccgtggaacttcgccgtatcggtgcccgtgccgccattgaacagatcgttgccggacccgccggtgaaggtgtcgttgccgacgccgcccaacaggctggtggcaccgctgccggcgattacattgagtgcaccggtcgccgccgaagcgtccagggcgagcgagccggtggaagcactggcgtccagggtggacaccccgctccccgcccccagggacagggccacggcacccgaaccggtcagttcgacgctctccacgccgctcagcttggacagactggcggccccggtacccgacaggacgagcttgtcggtgcccaggccgccgatcaccgtggcggcctgactcagatcgacgacattcatcttcacgatgtcgttgccgtcacccgcgtcgatggtggcaaagccgctgcccacatccagggtgtcggcggcgacggtgccgttcaacgcggtggtgctggcgctgtagccggtgagggcaatcctctgggagaaaactcccatgcccgagccgtcatcggcctgccacaccacttcgacgctgccatcggacagcagggtggcggagggatggctgtcgccgccggccgcgccggcgccgatcgcgaagtcggcctgggtctgctggccctgggaatcgaaacgccgccccatgatcacgcgggtacccgacacggccgtgtcgtcgtcccacaccgccaggaagcccccgtcggccagggcgaccaccgacggccaggcctggtagccggccgtgacggtggtgaccaggaactcggtccccgccgtgccgctggcggggtagccagcggggaaaatccgcccgtaggtgccccaattgccgtcggcgttgtcctggccctggctgtgccacagcaccacgaaaccgccgccggccaagggggccatggtggcccccgcctgggcgccgctggtggtggcgttgaccgtgaactcgcccaacagcgtccccgccgcgctgatgcgctggccgaaaacgtcgctgctgctcaaaccggtccacagcaccaccacatcgccaccgggcagagccacggcggcattcatgccatagccgctgccccagacatcgtggctggaggaaagccggatttccgcgccggccggggtaccgtccgcattgaacatgcgaccgaaggggtaattgctccccagggcggtgccaccggactggtcgctctcccaggcggcgaaaaagccgccgttcggcgtcgcggtcaccaccggccaggcctgatagccgacggtggtggagggaaccacgaactcggcaccgggggtgccgctggtcggccaggtcgaggggaagacccgcccgatcgtgccccagttgctgccgtcctggccatcgctgtgccacaggatgacgaagctgccgttgctcaggacggccacctgctgaccatactggtcgccgttgatggtcgtgttgaccgcgaattcgctaccgatcggagtgccggcggaattgaagcgctgggcgaacacgccagcgccgccgtcatagccctgccaggtcaccacatagccgccatcgggcagaagggcgatcttggcatccgtctggttgttgggcaggacggtattaaccgtcacgggcgcgccggtcggcacaaaggtgcccaatgccccgaccgtgccgctcagcgtcagggtgcgatcggcaaagaccagggtctcgacgccgctcagggtatcggtgccgtcgttgccgccgacggtgttgatgtcggtgaccgtgacgccacccgtgccggtggaaatgcggtaaccgtccagattgccgtggaacctcgcctgatccgcgccgaaaccgccgtcaaagacatcgttgcccgagccgccggtgaaggtatcggcgccgaagccaccgatgacggtcaaaggcgcgccgcggccggtggcgtcgacggcaacaccggcatcggtgttcaaggcgtccaggatgctgaacccggcccccgacgacaccgtgcccatggcgacggacagcggcgcgcccgaggccgccagtgtcagcacttcaacgccatgaatattggtgaacgcgctgtcagccaccacgccggtggtggtgaaggtcagcctcagaacgtcgttgcccgctccgccattcacagaatcggtgctgctgaaatcggacaggatgaagatgtcgttgcccgccccgccggtcagggtgtccgaccctgatccgccgtcaagggtggtaaccgacgacgttcccgtcgcggtcagggtatcgttgcccgcgccgccaaggacgctggagatgccgctgcccacgttgatgacatcggcaccggtgccgcccgtcagggtcagatagccgcctttgttgtccacggaaacagtcttggcatcactgaacgccacctgctcgacgccgtagagataggccgaaccgccgccggtgatggagaggctgccgcccgaaccattgaaggtcgcggcgccctcggccatctgcaggctaatggtgtccgtgccggcaccgcccatcatgctggtggtgccggtaccggccaacagagtgaccccggacgacaccgccgaggcatccaacgacaccgtcccgctgttggtactggcgtcgatggtggacagcccagaaccgcccaccagggacagccccaggttgcccgccccggtcagcgccagttcctcgatgccgctgagcttggcctggtcggtcgggctgatcacgccgatccccgacagagtcagacggtccgtaccctgcccgccgatcaccgtggtggccgccgccagatcggcggcactcatcttgatgacgtcgttgccatcgcccgcgttgatggagacaaagccgccgcccacatccagcgtatcggccagggccgaaccgttcagcgcctgcagcgccggcgccaccaccgtggcgttactggtgaaggcggaattgttgctgcccgaaaggtccgggatgatgccgcccgaggcggtggccgggttccacaggcccaccagtccggtggtcggaaccagggtcgaggccatgtccgcctgaatctgcgtcgggctgcgcgcgctgtcccagatggcgatggggccgtattcgctgtccatcggcgccatggtgtgatgcgcgctgccgaagatgacgttgacttcgtccgtatagttgttgggaaccgagagggccgcgccgtcggcgacaccgttcacgtagagctgcgagacccccaggtaatccacggtctgggtgatgtggtaccactgcccggcctgaacgacctggctgccggtcgaagagccgccaccggcgacgtaggaaatcagcgtgtgagtggtggggtcgaccgcgacggtataggtatagccgcccacggtatcttccatctgggtggcgttattccaggcgttggtccgcccgaagacattgcccggcaggcccgatgtcggcagggtgttgaacttgacccacacctccagggtcacatgcgccgtatggctgtcgaccagggagatgcccgatccggcggcccccaccagcgccagcccgccgccggccgattgccccgacccggaaccgagcgtaaagctgcggtcgctgaactgcagcgtctcgatgcccgacagagtatcggtgccgtcattgccgttcagggtaggattggtgtcgaccaccgtcacggtgccgttggtcatggagatgcggtaatcggcggcggcgccgctgaagatcgccttgtcggcgcccgaaccgccgttgatgatgtcgttgcccaggccgccggtgaaggtgtcggccccgctgccgccgctgagcacgtcgttgcccgagccgccgaccagggtatcagcccccgaaccagacgcgacggtcaccgcgccggtgcgcgacgccgcgttcaccagaaggtcgccggtatcgcccgaggcatccacccgggtgatggacgccacattgccggtcgagtcgagattgaccgcctggctgagcgaccctcccgacagccgcagggtctccactcccgtgacatgggcgaaggccgtggcgttgttcagggtgcccgaagtgaagtcatcgaaggcgatgctgtcgatgccggcaccgccggtcaccgtggcgccatcggtggtgctgacccggaagttgacggcggaattgcccgccaccagcacgtcggcgccgccaccgccaacgatgtcgtaataggccgccgtgtcgccacccttgatgtgatcggcgaagctggacccgcgcacaccctggatattgaccagggtgtcggttccggcggtgagcgtcccattgacgtaatagctgtccaccgccttgccggcggccacgcccagatagctgctgccgctcagattggcgatgattccggcggccgcatgcttgtagctggcagtgacaaagcctgtgccgccggtcagggtatcgctgcccgccccgccttccagacccgactggccgctggccgcgccggacagcacatcggcgaagttcgagccctccaactccgtgatataggtcagggtgtcggtataggtggccgtaccgccggtaagagtggccacgccgccgaccagcgaggccgtcaccggtccggcggcatagacgaagctgaccttgccgccagccaggctgtcgccggtaatggtctggttcgcgcccccggcgaagaaggtatcctctccgccattgccgaccatggtggtgacggcggcattataggcgaagatgtcgtcgccaatgctccccgtcagcgttccccccgtcagtgaggtggccaccgcggacgagggcgaatgggtcgagcccgtcaatatgctgccgattccggccccggtccccgcatactggtccttcaccaccagttggccgccgccagcattggcggaaagatcgatgaccagatcgttgcccacctggcgggcgcccttgaaccccgcatcgccgaccttggagccatccagaatgttgctgccggcggtatcgatgatggtcagggtgcccgacgcggtggccgccgccacataggtgtcattgccgctgccgccgatcaggctggcgctgccgctgcccgaggtcagagagaccgtgcccgaattggacagggcaatctcggtgataccgtgggcggccagggcggcgatggtggcggtgttgacgttggctggcgtatcgacaacctggatatggccgccgcccgtggtgctgaaagacagagtcaggccctgaaccgcggttataggcagagtcccgctgtcggtgaccacgaacgacgtgatgccgtggctctgcagggtggcaatcccggccgcggcgatatgggcggccgtgtcggagacacgggtatggccgctgcccgccgcgaccgtcagagcgtcggcgaccgacagggcggtgacgtccacatgaatactgaccgcctgattggtggtcaccgccgcggccgtaccgttctgcgccgtggcagagatcagcaaggtgcggtcgccgtaccagttctgcggcatcctgaccgacagcgtggcattggccgcctgggccgccgtcagggtgaggacaccactggcgctgggcgtcagggtctgaccgctcagaaccaccgtggagccagtctggaagccgctgatgctgaccgaggaaacggcctcgcccgtatgggtgtcagccacgttgagcgccaggtcaaacgcctgattctccaacccactgagcgtggtcggcgcggtgatggtcgcaccctgggtgaccggggtaacggtcaacgtcacctgcttgctggtatcgacaccgaggatggtgccgccgtcatcggtattgttggcggtggcggtaaccgtcagcacgatctggccgctgtaatcggtaggcggaatcaccgtgatggtggcactggcagcctgcccggcggtcagggtgaagttgttgccgacggcggtaatcaccgtcgagccgaccttgaggaccgatcccgacggcgcgccggaaatcaccacctgatccaccgtctcgtgggtattgccgtcgctgaccgccagactgaagctggcgctggcgttctccaagatggtgagcgatgacggcacggtgatggcagcgccctcgaccaccaccgacacagcggcattggcgctgaccgtggtggcggtggtggcgtcggtatagctgaccgtgtagctgaagctgtctttgcccgtatagccggcggtggcggtatactggatctgctgatggccgccgacggtgaccacggacaccgagccgtgagcggcggtgcccgccgtcagggtgtagccggcaagggtggtcagggatgtattgtcgccgccccgcttgtcgttggccagcacgtcgaaggtgtgggcacccgcctgggtatagacggaatccgccacggccgtcggcgtcgaatactgcaatcccaggttgtggatggtattgtcctgggcgacggcggtattggacacctggctaaccagtgtggtcaactgctgcacgaggctcgacgcattggcggcattggtggcctgagccgccacggcctgggccgcagcctgggccgtggccacgtccgcggagttgaaggcaataccggctgcggccgtataggcgttgtcgaccgccagcttctgaccatagatggtgttggccgtggccagatcggcattggtacccagcgccgacaaggccttggccgccgcctgggtcgctgccgccagcgccttgccggcggaatcggtggcaccgtggggcagagccggcaagatattggtcaggtaattgttagcatcggctccggcggctgcggccttggcctgggcggcgacaccggtggcgaaggccgctgcggcggcggtcttggaatccagcaccgtctgcagcgccgcgtcatagaccgacttccaataggcgatctgtgtggcgggattataggtctgggacagactcagggcggcggcggcatcgtttttggactggatcgcctgaagataggaattgccggcggtcaccaccaactgctcggcacggaaagtttcgctggcggcgacacccaccgcgttggtggtggcattggcggtgttaatggccgcctgggcggcggcgagatcggtgttcagcttggccagggtgctggtgacgctggccagattggcggcgctggccgtactggcataagcctgcagcgcgccctgataggcgacggcatcggccttgacggtgctaagggcggtcagaacggccgccggcgtccccagcaccgaggacccggccagaccgagcccttggcccacctggacaatcacgtcgtcgaaggcggcggcgaccgagcccaacttggccacgaccgtattgtaatcggcctgggtcgacgcacgcaccaccgagctggaatcagtggagtggctccgcgcgtcggcggccgcggtggccgcggcggcggccaaggtctgggcagccgagacatcggcggcggcggccaagtcgtcggccttggcggcattattcagcgccgcggcgatattgtccttgaccacctgcagttgcttatcgaagcccgatgcctgggtggtcgccgaatcgctggcggcggtcaccttgctcagcgccgattgcgccgcttggtcggcctgaatggcctgggccagagcggtggcggtggagcttttggcggcctgggcggccacggccgcgtcataggccgaatccacggcggcaaaggccgtctgagcattggtgatctgggtggccagggcggcctggatggtctccatctggctcttggcatagagcgccgtcccgaccgtcgaggcattgcccagcgcggtattgatggtgttgtaggccgccagggcggcgtcataggcggactgggcggcggggctggccgtggcatcggccagggctgcgtccttggcggccttggcggcattccacatgccgtagagcgtgccgaggtcggtgctgttcacgttacccagcttggcgaccagggcgctgtacttcgcctcgatggccgtcttcatatccaccaaggtgccgctggtcgccgcggtggaggagttaacgatggcgtgaacgtcggtcttggcggccagggcggcggccacgtcgtcggcccgcacctgggccgccgaggcctcggacgcggccagggtcagggtcgccttggcgttggccgccagcagcaactgcgcggcggcggtgctggccttggcattggccgtggtggcctgggcgctggcatcggcggcggcggcggcggcggcggacgaatggctcttggccgaggtcaggtcgacgtcgaggtcggcggcggccttggcggtatcggccaggcccaccttggcaccggcggtggcgctggcgtttgtggcatcatcggcggcgctggccgccgtggaatagtagccctggacggcgctgatcagcgacgccttggtggcattgtaggtggccagcgcggcccccgtgacgttgctcggcggagtcgcggcgttcagggcgtccagcaccgccttgatggcatcgcgggacgcggcggcggcggttgcggcatcggcagccgatttggccgatgtatgggcgctggcatcggcggtggcggcatatccctgcgcgtccgccaccgaagcggcattggcctgatcgagctgctgcttcagcgcctgggcctgggtcatggcctgaatggcgatggcgtcttcctgctgtgccaccgccacctgctggtcgacctgggccttgaccgcggttgcctgctgataggtccccaaggcggattggcgcgcggctgtcaccgccgcctgattggtgctgagagcgctggtgaagttggacggcaggccctgggtcacgttggcatcgacgccggtccaggcattgccgtcggtaccgatgcccagggaatggagaaccttcagagcgtcggtgaccgcgttggccgccgaggtctgggcgctcaaagccgaggttacttcggcgtctgcggccagtttggccgccgacgccgcattgaagccggtggccgaggcattggccaaggcggtggccgcgtcggcggtggcgcggccggcggcggaggtggcggaggtcagggcggaattgaccgtggtcagagctgcgctggcgatggcctccaacttggcctgccaggccgcctcgccggcgcgctcggcaccaatggcggaaccgtccagggccgagtccgtagcaacggtatcttgctgggtggcgtagttgctggcggcggtgaccgaggctgcctgtgccgtctggtaggcagtgcgggcatcggtcaaagcctgggcggcggtttcgtaatcggccttggcggcggcatagccggcctggatgtccgccaccgcgtcgtgccagagaaccaccaggggattggcgctggcgtccgcctgctgcagcgcgttgtaaagatccagcaccttgccggtcaaacccgcggccgacgcggcggtcagggcggaataggcctgatcggcggtccaatcggtcggcatggtggtgatcaacgccttggcagcgttgaggtaattggtcacaacgtccagcaggccgccggcctgtacggtaaaggccgcctcggcggacgccgcgttgaccagcggcgtctcgatattgagcagcgcctgatgggcagaggtaatggccgcttcggccaaggccttgagaccgggcagcagggcggtatcactggccagggcggcgtccttcaggccgcgagcggtgatcagcgagccatcgctccagccggctgcattggtgtcgttaaggccgttaacgagggcttcggcggtgctgtacttggcattggcatcggtgacgggggtcacgctgctcttgtcgttggccgtggtcagggcggtgacccaggccagcgcctcacttccctgcccgctgccatcggcggtgaccttggcggcatccgtggtcagctgggtcagggcagccttggccagagccagttcgtaagtggcggtataggtatcgccgccggtcgcggcggtttgggccttggtggcatgatcgatcaccaccagccggtcggccagtacctgggcgaaatccgactgggcctgggcggcggcggcggcttccttggccgccgtattgttcaccaggtcgtggaagacctgctcggccaccctgatcccggcgtcgcgggcatccttgaccagcccgaccaaagcctccttcaggccctgaacctgcttggtgacctgttggaccatggcctcctgaagggccttcatctggtccgcggcggtggccccctgctgaccggtggcgggcggcgttatggggggcggcggcggcacctgctgctgttgctgctgctgaagctgctgctgcaccgcctgggcggcggcgttgaaggcggcggccagcgaattggcggcgttgggcagcgccgcgccggcattgcccgccacctgcatgacctgcagcggcgacatctgctgcgccaccatggtgccggtggccgacatcaccgccgccgcgccggccgagttgagggtcatggtctgacccgacgacgaggtgacgctgacctcgccggtcacgccgttcttttccgccatcatggcgatggtgttgccgttgccggccacgccggtgccgcggatgccgacggtcatggtgggcgtcttcagcgacatggcgtcgggagacgccttggcaatctggcccgagaccagggcgaacgagcccgacaccagcgacatctgcgcgtcgccggtcttggcgccgggatcataggccagatggtcgaggaccagacggcccttctcgcccagggacatggtggtcccgtcggcgaaggtcacgcccacggcgctgccctgcgcggtctgcaggacgtcgccctccagaacgttgtcgcccttgtgcagctcggacgtggtgccgtcggcgtgcttgacgctgaccgtcccgttcagggtttccaccttgccgatggcggtcgcgccggacccgccgcccgcctgggcatattggcccggcgccagcggcccggccagcttgccagccagggcggcgtcgatcaccgcccccgaatcattcagcagcggcggcggattttccgaaccgaaataacccttgatcaccacgcgggaaccatcggcgccgaccagcaccagatcgctgccctgacggacgtattccgcgtcgaccagaagattgccgcccggcaccaggatcttggagaggccggcggcttcgatgatggtggccggctgtggcttcacgccccccccatggcttccctcgacgccctttgcaccggccccgacctcaccccccgaattggaaggccgttcatctctaggcgccatgccaccctcttctcaaaattcggccacacgccaccgtcggcgcgcgacagccacttcgcaccactctgcatgatacgatgttttacgagaaaaggtcaatatacagcgttcaccttacgcaattattgccgccgcaaagcaaggcaaaccccacgaagcgaagcaacaacagcagaacacaccgaccagaggccgaacaaaatacaataaaatatcgacgcaaccccacaacattgagcaacagtatctttgcgagatcagaaatagtcagcaataagcacaacaggtcacatacttatcattgatcgacctcaaaaggccgagccaccccacccagttatttgcaagaaaagctgagaggtacggcacatcgcaaagccgtaggcagaaaattaaccctgggtttcagcaagggaaaagcggaaaacgctgccccgatcaggctcggactcgacccagatccggccgccgtggcgctcgacgatcttcttgcagatcgccagcccaatgccggtgccgtcgtaatgctcgcgggtgtgcaggcgctggaaaaccaggaagatgcggtcgaaataagcgggctcgatgccgatgccgttgtcggccaccgagatgacccagccccccgcccccggctcggccgtgaccgtgaccacgggttggcgatcgggggaccgatatttcagcgcattgccgatcaggttctgcaacagccgcagcatctgggagcgatcggcggtgacctggggcatgggaccgacttcgattcggcccccggtctcggtcagcgccgcccccagattggccatgacgtcgtccagcacctcgcccatcccaaaggactcgaactgcccgcccagccgctcgacccgggaatattccagcagatcgcggatcatggcctgcatgcgcttggcgccatccaccagaaaggcgatgaactcgtcggcatcgtcatccagccgcccgcgatagcgccgctcgatcaactgggcatagccggcgatcatgcgcagcggttcttgcagatcgtgggaggtgacgtaggcgaactgctccagttccttgttggaggcatcaagcctgaccagcagttcccgggaccgggcctccatggctttgcgctcgctgacgtcgcggcatatgaacagcaggcagtccaggtcgtcgagaaccaccttctgcaccgcgatcagcgtgtcgaagacctcgccgttcttgcggcgcagccgggtctcgaaattgaccacctgcccgtcgcggcgggcggcctccaccagcctggcccggtcctcggggtcagcccagacgcccattcccaaggcggtgtgccccatgaggtccaagcgggaatagcccaacatgtcggcgaaagcgtcattgagatcgatatagcgcccgtcctcggtcagggagatcaccatggcgtcgggactggcgcggaaggccttggcgaatttttcctccgacagccgaagacggcgctcggcctccttggcggcggtgatgtcctcgatggtccccaccagcccgccggcgggcccctcctccaccgacagcgccgcggcgtggccgcgcacccagcggatggcgccgtcgccgcgcatcaggcgcatctccgccagaaactcgccctggccgttcacatggccgcgccatagagccgccaccgcctcgcggtcgtcgggatggaccacctggcaccatttctcccccaggagttcgcttcgtccccggcccgccagttccagccagcgttcgttggcataaaggcaggtcccctcggcatcggcctggaacacccccacgggggagtgctcggtcagcatgcggtagcgagcctcgctggcggccagggcctgctggacacgctggcgctcggccagcctccggtccgacaccatggccagaccaaaggtcaccagggccagaagcaaggtcgcgccgccctgcagcgccgtgtcgcgggaccaggtcatcaggacctcggtcagcgacatccccaccgccaccaccagcggatgcttctccagccggcgataggcgatcacccgttcgtggccgtcggtggcagaagttccgagaagcgttccccgcggcgccgtggccaggtgagccatcacggcccccttcgccaccgagaccccgcgccaggcgtcgctgttgggcagccgggccaaaatgatgccgtcctcgcgcagcaaggtggcgcgcccgccgtcgctgggcaggaccgagcgcaattcgtcctcgaagatcttgggatcgaccgaaacggccaccatgccagccagccggccgtcctccgtgcggatgggacgggccgcgatgatgctgtttcccgtcaccacgcggctttgcagcggtgcgctgatgaaaatgggaagcgtcggattctcggccagggccttgaagtactcgcggtcatgcacatcggtgcccgccatgccgggcatggtccccgccaccatgaccccccgggcatcgatgaacacggcgctgcggatctcggggatgaacttcatgcggttggcgagcgcggcgagggcgcgctgcgggtcggcgacccgcccgtcgggagccacctcctccatctcggacagcaactgatcgatgctgcgcatcacgcccgcgatgtgctcttccgagacccgggtcaacgcctcgaccagatgcttggtatcggcgatttccttgcgatacgagcccaccgcctgccagatggtcagcgccgccagacagggaatcaccaccatcgccagcaagcgggcccgccaggaattgcccggccgggtcagacccgccacgtcatggccggcgccttgcgatggcgccttggagggcggttccggctgctgctcgttcatgcgcaaaagaatacatgcggatggttggtctaacaaccatggcaccatacccctgcatcagcggcccatcagcgctgcctattgacctccgcccccaccactcgctaaaaccaaaccgttcagtttagcttggcggcacctccctgcccgccgtccggcatgaccgagatttcccgacacacccgccgaaacgagaccggacccatggaccatcaaccgcgtcgtcccaagcttccgcttcccgtcctgctgctgggcggactggcgctggccggcgtggcggcgggcgtggtctcgttctcgtccacctcgtcgggaccggccggcgcgccgccgcccgccggccccgccgtgacggtggccacgcccgccagccgcaccatcaccgactggagcgaatacaccggccagttcgccgccgtggattacgtcgagatccgggccagggtgaacggctacctgaccgaagtgcacttcaccgacggccagctggtcaacaagggcgacctgctgttcgtcatcgacccgcggccttacgagatcgccctggcctcggcccgggccaagctcgaccaggccatgggcaccaaggaatacgccaagcggcaattgtcgcgggccggcgagttgcaccgcaaggaattcgtcgccgagagtaccctggaccagcgcaccgaggaatcgcgtggcgccggcgccacggtggaggcggcccgcgccgccgtccgcgacgccgagctgaacctgcaattcacccgcgtcaccgctcccatctcgggccggatcggcgccaagcaggtgagtatcggcaatctggtcaccggcggccccaccgtggcctcgcccaccttgctcagcaccatcgtctcccaggaccccatccacgtgaccttcgacctgaccgaggccgattacctggcccaggccaagcgcggcaacgcggtgggcacgccggtgcagttgcggctgatgagcgagaccggctggccgcgcgaaggcaagctcgacttcgtcgacaaccagatcgacaagggcactggcaccatccgcgcccgcgccgtcctggccaacgccgagggccaagtgccgtcgggggccttcggccgggtccgcctcgccacctcggttccctatacgagcctgatggtgcccgacactgccatcgtcaccgaccaggcgcgcaagctggtgatgaccgtcaaggacgggacggtggtgcccaagccggtggttctcggccccaaggacggcgaattgcgggtgatccgcgacggcctcgcccccgacgaccaggtgatcatcaacgggctgatgcgcgcccggcccggcgccaaggtttccgcccagcccggcaagatcgaatagcgggatcggacccacgccatgcgcctgtcccactttttcatcgaccgccccatcttcgccaccgtggtgtcggtgctgatcaccatcatcggcgccatcacctatttcgccctgccggtggcccagtatcccgagatcgcgccgcccaccatcgtggtcagcgcctcctatcccggcgcctcggcccaggtggtggccgacaccgtcgccacgccgctggagcagcagatcaacggcgtcgagaacatgctgtacatgaacagccaggccaccggcgacggcaacctgaagctgaccgtgaccttcgctctcggcaccaatctcgacaccgcccaggtgctggtgcagaaccgcgtggccatcgccaccgcccgcctgcccgacgacgtcaagcgcatcggcatcaccgtggccaagaactcgcccgacatgctgatggtggtgcacgtcaattcgcccgacggctcgcgcgagcagttgtacctgtccaatttcgccacgctgcagatgatcgacgtgctggcccgcctggacggcgtcggcgaggtgcgcatcttcggcgcgcgcgattacgccatgcgggtgtggatcgacccggacaaggcggcggcgcgcaacctgaccgccggcgaggtggtcaaggcgctgcaggcccagaacgtccagatcgccgccggcgtgctggaccagccgccggtgcccaagcagggcgccttccagctttcggtgcagacccagggccgcctgctcgaccccgcccagttcggcgaggtcatcgtcaaggccgattcctcgggccgggtggtgcgcctcaaggacgtggcgcgcatcgagctgggcgcccaggattacagcgtcaacggctatctcaacggcaacaacgccgtgccggtggcggtattccagcgccccggctccaacgccctggccaccgccgagcgggtcatcgccaaggtggaggagctgtccaggaccttcccctcgggcgtctcctacaccatcgcctacaaccccacccagttcatcgcccagtcggtcaaggcggtgatcaagaccatcttcgaggcggtcatcctggtggtcttcgtggtgatcctgttcctgcagacctggcgggcctcgctgatcccgctggccgccatcccggtgtcgctggtgggcaccttcgcggtgctgggcgccatggggtattcgctcaacaacctgtcgctgttcgggctggtcctggcggtgggcatcgtggtcgacgacgccatcgtggtggtggagaacgtcgagcgcaacatgaaggacggcatgaacgcccgttccgccgcccaccagaccatggacgaggtgggcagcgccctgatctccatcgccctggtgctgtgcgcggtgttcattcccgccgccttcatccccggcatctcgggccagttcttccgccagttcgcggtgaccatcgccgcgtcgacggtgatctcgctgatcgtgtcgctgaccctgtcgccggcgctgtgcgccctgctgttccgcggccacggcccgctggaccaccacgaggagaccggctggcgccgccaggtggcccgcttcttcacctggttcaaccataatttcgaccggctggccggcggctatggcggcatgacccgctcggtggtccgcaagtcgggaatcatgctgctgctctatgccgggctgatcggcgccgccggggtcgagttcgtcaagacccccaagggcttcattcccgagatggaccaggggtatctgatcaccgtggtccagttgccgcccggcgcctcgctgtcgcgcaccgacgcggcggtcaagcgtgtcgccgccatcatggccgagacccccggcgtggcccataccctggccttcgccggcctggacggcgccaccttcaccaacgcctccaacggcgcggccatcttcacgcccttgaagcccttcgaggagcgctatgcccaggggctgtcggccaacgtgatcatggccgacctgagaaagcgcctgtccacggtccaggacgccttcatcatcaccatcgccccgccgccggtgcgcggcatcggcaccgccggcggcttcaagatgatgctgcaggacaagggcgggcacgggtccaaggcgctggaggacgtggcgctggacatggcggccgaggccaacaagattcccggcctgcagggtatcttcaccctgttcaacacccggacgcccaatgtctacgccgacatcgaccgggtgcgcgcccagatgctgggggtgcccaccgaccgggtgtccgaggcgctgcaggtctatctcggctcggccttcgtcaacgagttcaactatctgggccgcaccttccgcgtcaccgcccaggccgacgcccccttccgcaacgaagtggaagacatcgccaacatcaaggtccgcaacgacaagggccagatggtgcccatcggcgccgtgtcctcgttccgcttcgataccgggccgtaccgcgtgccgcgctacaacctgttcccggcggccgaggtgcaggggtcggcggcgccgggctatgccagcggctatgccctggagcagatgcgagccctggcggccgagcgcctgcccgagggattcggcttcgagtggaccgagctggcgctgcaggaattgctggccggcaacaacggattgttcgtgttcgccgcctcggtgctgttcgtcttcctactgctggccgcccagtatgaaagctggtcgctgcccgccgccgtggtgctgatcgtgcccatgtgcctgctggccgccgtcaccggcctgatcatccggggtctgcccatcaacatcctggcgcagatcggcttcatcgtgctgatcgggctggcggccaagaacgccatcctgatcgtcgagttcgcaagacaggcggaatccgaaggcatggaccgcatcgaagcggcggtgcatgccggccgcacccgcctgcggcccatcctgatgacctcgctggccttcatcctgggcgtgctgcccctggtggcggggactggggcgggcgccgaaatgcgccagagcctgggcaccgccgtgttctacggcatgctgggcgtcaccgccttcgggctggtgttcacgcccatcttctacgtggtgatccgcaagatggtggcggggcatcacgcccgcgccgccgccgcccacgcggccgaggaagcgcgggggcggtagatccgcccccgcgtcgcccgactacttcagggtcttcaggtactcgaccatggcggagacgtccgctgggttcttgaggccggcgaacaccatcttgttgccggggatggtgtccttgggattggcgatgtaggccgccagattggcgtcgtcccaggacttgccccagccggtcagagccggcgagtacttgaatcccgccgcggcggtgccggccttggacccggccacgccgtgcaggctgggaccgatgccgttggcgccggcttccaccttgtgacaggtcttgcaggccgaaaaagcggccggcggctcggcggccagagcggtaccggccagggccaaggctgcggcgaaggcggcaagctgaagcttcatcggaatggtccccctaatacgtttgttggtaccgccaagaaaagcatcatttgcgctttgtcacaacaggtcaggcatctccttggccaggctctggcgctcgttgacgcgggtgccggacagcgcgaagcccaaggccttgccgccgggcgagacgaacagcgccttgcggtcgcggccctcgccctccaccacccactcgccggccgcgccgggagggggcgggcagaccgccatgggaagggccggggtcttgaccaccaccggcagggcgggcagcttcaactcggtctcggtcccggccagggtggcggccagggtcttggcctcggccatcagcggcagaacgaagggcaacggcccggcgggagtctcggcgcaatcgccgatggcgaagatcgccgggtccgaggtccgcaaggtccggtcgaccacgatgccccgctccaccttcagccccgcctcggccgccagccggatgcgcggcaccagcccgatggccgacagcgccaggtcgaaggcgagttcggtgccgtcgtcaagaacggcgcgccccgccgagaaccgggccaccgaacgccccaggtggaaggtcacccccgccgcgcccagcgccctggccatctcctcgcccagcgcctggggaagcaggcggccgagcggccagggcgccgggtcgaccacggtgattccatacccggctcccaccagatcattggcgaattccgagccgatcagcccggcgcccaccagcaggacccgcccgccggcgcccagcgcggcgcgccagtcggcgtagtcgtccaggtcgttgacggtgcggatgcgggcagcctcactgccctcgaccgtgtaggcccggggatcggcgccgatggccagcaccagccggccataacccagctccacctcgccgccgtcgggacggcgcagcaccaccgccttggcgtcgcggcggatggcggcgacccggtggcggaccaggatggtggccgatagatccgccgccatctggccggcgctcttctgcaccagggtcgtggggtccttgccctgggcgaaggcggcggacagcatgggcttggaataggattccccgccatccgcggtgacgatggtgatggcgacgttggcgtccagcttcctcaactcgcgggccagggtatatccccccagcccgctgccgaggataaccacgccgttttgggtggcggcggtctccatgggtcagtcctcctggacttcgaagtccgacttggacacgccgcaatcggggcaagaccagtcgtcgggaatggcttcgaagggggttccaggcgcgatgccgtcatcgggcatgcccacagccgggtcatagacgaagccgcacacgacacagacatactttttcatgatcgggtcctccttggttttggggctcaggcggggttggccgtttcagatggccatcttgggcgggatccaggcggcttcgctatggggctcgaaatcggccttggagcagccgcaatcggggcacgaccagtcgtcgggaatgtcctcgaaggcggtgcccggggggatgccgtcctcgggcagaccgaggacggggtcatagaccaggccgcagatcacacagatccagatttgatcatcgctcatcatcggtctccttgcgttgccgctcagcccttgtgggcgtccagggtggcctggtagtggccggcatgcttttcctcgacctttgccagggcggcgaagcgcttggcggcggtggccaggatcttggcgaagcgctcggcgtgttccttggactcggcgatctgcccgtccatttcggcgacggcggctttgttgccctcctgctcggccagatgacggaacttggggtacatctcagtgtactcgtaggtctcgccgtcgatggccatctgcaacatcttctcgaccgtcagttcggccttgggatagagcagttcaagatgcccgaaggcgtgcatggtctcctgctcggcggtgcgctcgaagacctcggccacctcgacggcgcccagttcgcgcgcccggcgggcgaagtagagatacttgcggttggccatggactcgccggcgaaggccgcttcgagattggcgatggtgggggatgcggggttgaaggccattggggtcatctccttggtgtgatccgatggagaaaccctacagaaacaaactgatcgaatgaaacgagttaaagctgtttttgaaatcgactcagtcgatcacttccccgcctgccagccgccacccaaggccttgtagaggccgacgatggcctgcatctgggacagccgggcctgggccagggcatcctgggccgagaacagggtcttttgggtgttgagcacggtggtgacgtcgacgatgccgccggccatctgggcctgggcgatctcgaaggcgcggcgtgccgtggcctcggcgcggcgctgggattccacctcctcgaccgccatctccacggcgatcagggcgttctccacgtcggagaaggccgaagccaccgccttgcggtaggtctgggacagttcctcgaagcgggcgcgcttctgctccaccgtcccggcgatcttgccaccgtcgaagatggtttgggtggcggtggaggccactgaccacagcaggctttgcgccgtcatcatcttcagcaggtccaggctctgaaagcctccctgccccgtcagcgagatggcgggaaaccacgcggcgcgggccgccgcgatatcggcgttggcggcgcgcagggatgcctcggccgattgcacgtcgggccgccgggccagcagttccgacggcagccccgcccccaccaccggcacggccaggccgcccagggtctcgggcaccagggcgaattcctcgggcatgcgtccggtcagaatggccagggcgttgtagtcctggcgcatctggcgctccagcggcgccagggtcgcccgttgggtggccagcacgctttcctgctgcgccacatccagcgaggtggcggtgcccgcccgctggcgatcgctgaacaccgccaggatgccttcggaattggcgatggattccttgaccagccggatgcgttcctgcaggcccaggatctcgaaataggtggtggccacccccgactgggcggtcaggaccgccgtctgcaaatcgaagcgcgacgcctcggccgcggcctgggccgcgtcgaccgccgcggcgttcttgccccagaaatcgatctcgtagctggcggtcagggtggcgctggtggtgctggtgtgccgcgccttggtggtggtggtggtgctggccgcccgcgacgcccgcgcccgggtctcgccggccgaggcggacagcgagggcaacagcgacgccccggccacccccagttgggcatcggcctgacgcacccgcgccgtggcggcggccagatcgaaattggcggtccgggcccgcgccatcaattcgtccagacgcggcgaattgaactgccgccaccagtcgctccccggccagacattgccctgggccgcgttcttccactgggccggcggcggcgccggggggcgcacatactcgtcacccaccgagcaggccgacagcacgacgagggcaagggcggaaagggcttttctggtcacgtctggatctcctggcggcccggcgcggcgctgttgatattacgataacggaagcgtcgtgtcccggttacaaggcattcacgtctgccctgcaaaatatcgctgcaaaagccgaattccggcatttctaccggccggggctgcgatcgcggtcggccggcggcggccatctcgcctcgcataattaccatgcataatatgtggacaggctgccggaaacgccggtgccgtccgggccgggccggtcctcgggacggcggcctcgcatcccggcggggcatcgtgccgcaactccagagattcaaccttgaaggcctgttgatggagttgaaacaagtcctggcgacagccgttacaccccgttcacaggggcatcgcaaaatatcactgcataatttgtaagcccgcacaaatccaggccgacacatggcgacacaagtcagcgcgccaccgccctgaccttgcgaaaagaccgtgcgaaacatgtggacagactggggaaagccgctaccatccggccccatgcacagggatacggttgaatcatgatcgtcggctatttccgcaagatcgatggcggcgaagaggcggctcccaccgccgtcctgcgggccgagcgctgcctgcgcatcgagaccgacgaggtgggacgctatggagcccgcaccgtgctgctggcctcgctgagcaatggcgacgtgctggtgtcgccctccatcgcccatctggccccctcggtgagcgaggtgctgcgcgtctcgcgccatgtgcacggacgcggcgccaccctgcggctggtgctggaaaagatcgacacctcggtcccggcggcgcgcaacgtgctggccgccttcgccgagttcgaaagccggcagttggccgagcggcgcaatgcgggcctgtacgaggccgccctgtccggcgccaggcccggccgcccgcgcaagctggacccggcgcgcatcgcgctgatcgccggggaactggccggcggccgcaccgccgcctccatcgcccgcgagctgggggtgcaccccaccacggtgacccggctggcccgcctcgccgccaccggcgaggatgagctgggctgaggccgccctcacgccgcggcctccgccttgcggcccttgcgccacgccgagaggcgcgccagccagagatagaccaccggcgtggtgtacagcgtcagcaattgcgacagcagcagcccgccgacgatggcgatgcccaggggccggcgcaacgctccccccggccccgaggccagggccaggggcactgcgcccagcagcgcggtcagggtggtcatgaggatggggcgaaagcgggtgcggcaggcctccaggatggcctccaggggctgggcgcccctgcgctcggcctcgatggcgaagtcgaccatcaggatgccgttcttcttgacgatgcccatcagcaggaacacgccgatgacgctgatcagcgttagctcggtattggtacccatcagggccagcagcgccccgatccccgccgagggcagggtggagatgatggtgatggggtgcagcagactctcgtacagcacgcccagcacgatgtagatggccagcagggcggcgccgatcagcaccggctggtcccgaagggattcggcgaagaccttggcgttgccggcgaattcccagcgcaccccggccggcaggccgatctcgcgcgccgccgcctgcaggcggatggcggcgtcgcccaggggaacccccggcgcgagattgaaggtcagcgtcgccgccgggaactggccctggtgggcgacggaaaccggcgcggtggaggactcgaagcgggccagggactccagcggcacctgacggccgtcattggacttgacccacagcagatgcagcgacgacggatcctcctggaaacgggggtccacctcgaggaccaccttgtactggttacgctgggtatagatggtcgagacctgccgctgggcgaaggcgttctgcagcacctgatccacatcggtcatggaaacgcccagccgggccgccgcgtcacggtcgaccaccacctgcatctggggaatggccgcgtcctggtccgacgagacgtcgagcaggccgggctcggccttgaggcgctccaccagcttcggcgtccactggcgcagttcctccagggattcgctccacagcacgaactggaactgggccttgcccatgcggccgccgatgcggatgtcctggcccgccatcaggaacaccgagacgccctcgacccggcccagcttgggccgcaggcggttgatgacatcctgggcggaatccttgcgctcgcccagcggcttcaggctgatgaacatgcgcccggtattgccctgtccgccggggccgccccccgacccgacaaaggagcccagcccctccaccgccggatcggacaggatcacctcggccaccttctgctggcgctcggagatggagcggaacgagatatcgacccggccctccacgctggcgaagaccagaccggtgtcctggggcggaaagaaccccttggccacctgaccgtacaggaacaccgtcagccccaccgtgcccagggtgacggccagcatcagccagcgatgggccagggcgcgggccagggtgcgctcgtaggcgcgttccagccagaccatggccgtgtcgcccgccttggccagccccgacagcgggcgcggcttggcccggaccatcagatggccgaacagggtgggcgtcacggtcagcgacaccaccgccgagacgatgatggccaccgacagggtcacggcgaattcgcggaacagacggcccagaatgccgcccatgaacagcaggggaatgaacaccgccaccagggacagggtgatggagacgacggtgaagacgatctccttcgatcccttgatggcggcctccagcggcccctcgcccttttccatgtggcgcgtgatgttctcgatcatcacgatggcgtcgtcgaccacgaagcccaccgagatggtcaccgccatcagcgagatgttgttgagggaatagcccgccagccacatgaaggcgaaggtggccgccagggacaaaggcacggtgaccgaggcggccacggtgggggtcatccggcccagggtcaggtacaccaccatgatgaccagcccgatggagatggccagcgtggtctccacgtcgtcgagattgccgcggatgttgatggtgcggtccgagaccaccgagaccttggtgccggccggcatccagcgccgcaattggggcaggatctccttgatgcggtccaccgtctcgaccacgttggcgcccggctgcttgctgatgatgatcagcacgcccttgtcccggttgaaccagccgcccaggcgggtgttctccaccgaatccaccaccgaggccaccgccgacagccgcacgatggcgccgttggacgatttgacgatcagcggcgcataggcgctggcggtgaacagctggtcgttggcattgatgctcatggcctcggtggcgccgtcgaggaagcccttgggagtgttgacattggcctgagccagagccgtgcgcacatcctccagccccacccccatggacgccagttggccgggattgacccggacccgcacggcgggcttctcggcccccgacagcgacacctgcgccaccccgtccacctgggagatgcggctggccaggatggcgtcggcggcgtcgaacaccttggccgaggtcagggagtccgaggtcaccgccaggatcagaatgggcgattccgccgggttgatcttgcggtaggtgggcggcgacggcaggtcgacggccagctccgaggcggcggcgttgatggcggcctgcacgtcatgggcggcgccgttgatggaacggtccagatcgaactgcacggtgatggaggtcgagccctgggtgctggtcgaggtcatctcggccacgccgggaatctcgcccaggcggcgttccagcggcgccgccacggtggcggccatggtggcgggatcggcgccgggcaggcgggccgagacggcaatggtggggaaatccaccttgggcaacggcgccaccggcaggcggtcgaaggccaccatgccggtgaggaacagccccaccgccagcagcagggtcgccaccggacgacggatgaagatggcggagaagccgccgtccatcccccctactccgccggagcggcagcgggcacgaagcgccgcttcaaccgctcgaaggcaaggtagatcaccggcgtggtgtacagcgtgatcagctggctgagcaccagtccgccgacgatggaaatgcccagcgggcggcgcaactcggacccggtgcccgcatcgatggccaggggaatggcgcccagcagcgccgccatggtggtcatcatgatgggccgaaagcgcagcaggctggccttgacgatggcatcgcggggattcaagccctcgtgccgctccgcctcgatggcgaagtcgatcatcatgatggcgttcttcttgacgatgcccatcagtagcacgatgccgatcaggcccaccagcgacaggtcgtggccggtgaccagcagcgccagcagcgccccgatgcccgccgacggcagggtggacatgatggtcaccgggtggatggtgctttcatacagcacgcccagcacgatgtagatcaccaccatggcggcgacgatgagccagggctggctgtccagggcgcggcggaactcggccgcgtcgccggaatattcccccgtgatggtctcgggcatgcccatctcgtgctgcagtgcgtcgatggcggcggtcgccgcacccagcgaggcgccggaggccaggttgaaactgatggtcaccgccggaaactggccctgatgggtgatcagcagcggcaccctggcccgggtcaccgaggccaccgccgacagcggcaccagggcgccggaggaggagcgcacatacagcgcccccagcgcctccggcccgccctggtattcgggcgtcacctccaggaccaccttgtactggttgacctgggaatagatggtggaaatctgccgctggccgaaggcgtcatagagggtgtcgtcgatggcctggggcagcacgccgagccgcgccgccttgtcgcggtcgatgcggatgtcggcctgcagccctccttcctgggaatccgtggccacgtcggtgagcagcggcgaggcgcgcagccgctccaccacaagcggcacccattgggccaattcgacggcatcgatgtcggtcagggtgtactggtactgggtgcggctggtccgatggctgatctggatgtcctgggccgggcggaaatgcacctccatgcccgccaccggcgacaccttctcggccagccgggcgatgatctgctcggccgaggcagaacgctgcttgcgaggcttcaagacgatggtcatctggccggtattggcggtgggattgatgggacccgccccgatgaacgaggccaccgccgtgacatccgcgtcggtgcgcgccagctcggacacccggcgctgcatgtccatcatggtggagaacgacacgtcggcccgcgcatcggtggtggcgacgatcagtccggtatcctgggtgggcaggaagcccttgggcatgaagacgtaaaggccgatggtcagggccagggtggcgaaggccacccacagggtcgccgcctgatggcccagcacccagtccagggagcgggcataggcacggctcaacgccaggaagaagcgcccggacttggcctcctcgtgcccgcccttgagcagatgggcgcacatcatgggagtcagagtcagcgacaccaccgccgagaccaccacggcgacggccagcgtcagggcgaattcgcgaaacagccggccgacgatgccggtcatgaacagcaggggaatgaacaccgccaccagggagacggtcagcgacacgatggtgaagccgatctccttggaccccgccagggcggcatccaggggcttcatgcccttttcgatgtagcggacgatgttctcgatcatcacgatggcgtcgtcgaccacgaagccggccgagatggtcagcgccatcagcgacaggttgtccaggctgaacccggccagcgccatcaccccgaaggtgccgatcagcgacagcggcagcgccaccgccggaatcagggtggcacgcaccgagcgcaggaaggcccagatcaccccgatcaccaggatgatggtcagcaccagggtgaactccacgtcggccaccgaggcacggatggtctcggtgcggtcggccaggaccgagaccttgacgccggtggggacgacccgggtcagttccggcagcttggcctgcagccggtccaccgtggcgacgatattggcgccgggctggcgctggatgttgaggatcaccgccggcttgccgtcgaaccagccggcgacgcgggaattctccacgccctccaccacgtcgcccaagtcggagacccgcaccggcgcgccgttcttccaggccaccacctgagcgggataggccaggggatcggaaatttggtcgttggcgccgatggacagggcctgggccacgccgtcgaagctgcccttgggcatgtccacattggccttggacagggcggagcgcacgtcctccagcgacaggccgtaggcggcgagacgggccgggtccatgcgcacgcggaccgccgggcgctggccgccctcgatcagcacccggccgacgccgccgatctggctgagcttctgggccagcagggtgtcggccacgtcgttcagccgggtgatgggcaagctgtccgaggtcagggccagggtcatgatcggcggatcggcgggattgaccttggaatagaccggggggtagggcaactgggtgggcagcacgccgcgagccgcgtcgatggccgcctggacctcctccgaggcgacgtcgatgctcttggacaggtcgaattgcagggtcagggcactggtgccctgggacgaggtcgaggtcatcaccgccagaccgggaatcaggccgaactgacgctccagcggcgtggtgatcagggtggcgatggtctcggcactggccccgggcagttgggtggtcacctggatggtgggaaaatccacctggggcagggccgagaccggcagcagccgaaagcccaggatgccggccagcaccaccgcgaaggccagcagccaggtggcgacggggcggcggatgaaaggcgccgagacgttcatgaccggttggcctcacaggattttgtcattccgagcgcaggcgaggaatccccgcctggagggacggtgccgattctgacgggccggaccaggacgagatccttcctcccgttggtcgtcaggatgacagggtcatgcgttctgggccggattccgggcgtcattgcggcctgcccgcgcggccctttccctcaccgcgaccctggccttgcccctggccctcgccggccttgtcgccggtgctgatgcgggcgccgggctgcagcttggcggtgccctccaccaccacggtgtcaccctcggccagtccttcgtccaccagggcctggcccgcctcgacggtggcgaccttgaccgcgcgcatctccacggtgcggtcctccttgacggcgaagacatagggtccctgggggccgcgctgcaccgcctgggccggcaccaccagcccgtccttgcgcgtcgacagcagcagccgcacgttgacgaagccgcccggccacagcttgcgctcggcgttgggcatcaccgccttcagcttgatggtgccggtggtctggtcgatctggttgtccaccagttccagctcgcccgtgtcggccagcgcccgggtttccggccgcagggcctgaaccgcgagcttgccatccaggcgcaactgctcgttcaccgccgccagggattgctgcggcagggtgaagaccaccgaaatgggctgcacctgggtcagcgtcaccagaccggtggcgtccgacgcccgcacgatgttgccgcgatccaccagccgcatgccggtgcgcccgtcgatgggcgcggcgatcaccgtataggacagcatggtcttggcattggaggccgaggcctcgtcggcccgcaccgtggcctccagctggcgcaccagggcgcgctgggtatcgacgctctggcccgagacgcggtcgcccaggctgacatagcgggccagatcgcgcttggctgcctccagttgggcgctgtccttgtcgcgggtggccagggcctgctcgtattgggcgcggtaggtgcggggatcgatctgggccagcacgtcgccggcatgaacgtcctggccctccttgaacaggacctccaccagttcgccgtcgacccgcgagcgcaccgtgacggtgttataggcctgcaccgtgccgatggcgtcgagatagatgggcatgtcgcgccgggcgacgctggtcaccgtgaccaccaccgggcgtccgtcgggaccgccgggccgaccgccggtcttagccggctgcggcgtgggccacagcgcgaacgccagaccggccgccgccgccagaccgccggccagggtcgcccgcttgcgccaaacagggttcttgagatcaaaggaaggcaaggcccgctcctgggaattccgtcggcctggattatgaccatagcgccccggcctgtcagtaacagagggtaacaccgtgttcgcccccgggctgctgtggtattttcattcggttaataagaaacttatacttcatgcatattctctcgctaggatactacccattcgcaaggggccgggagggaaccatccatgtggattgaacaacgggtctggacggcccaggccgggtggaccgtgaccggagccggttcggacaagccgtccctcgtcctctatttcgcggcgcccggaacgttgccggccgaggatatcctggccgacctcagggccgcctatggcgacgcccccatcgtgggctgcaccacgggcggcgagattctcggctccgaagtcatcgacgattcggtggtggtttcggccctgggcttcgccttggcctcggtgcgggtggccagccgcgatcttgccgacctgtcgcaatcgcgggcaaccggcgccgccctggccggcgatctggcgggcgagggcctgcgcgccctcttcatcctgtcggacggcaccaaggtcaacggcgatgccctggtggcgggctgcctgtcggccgtcccgcccgacgtggtggtgaccggcgggctggcgggtgacggcgcccggttccagtccacggcggtgggctgcgacgatcccatgcgtcccggacgggtggcggcggtgggcttttacggcgagtcgctctccatcggccatggcagcttcggcggctgggatgaattcggcccgccccggaccatcacccgctcggcggccaatgtactgtacgagctggacggcgagccggccctggatctctacaagcgctatctcggcgacgaggcgcaaggcttgccgggcagcgccctgctgttcccgctgtccatccgcccggcgggcgaggacgccggcggcgaggtggtccgcaccatcgtcggcatcgacgaacaggccaagtccatgatttttgccggcgacgtgcccaccggccatctggcccgactgatgcgcggcaatttcgacaatctggtggacggcgccgggcgcgccgccgaggcggcctccgcctcggtcggaccctgcctgggcctgctggtcagctgcatcggccgcaagctgctgatgggccagcgcatcgccgaggaggtggagatcgtctccgacgtcctgggcaaaacggccagcctgatggggttctactcctacggcgagatctcgccgcacggcttcaccggcaaatgcgagctgcacaaccagaccatgaccatcaccaccatatccgagcgctgattgtctcctcccgcccctcttcaccgcctgctgcagcgccagctggcccgcgcctcccgcggcacggccgacggagcccccgattacggcgcgctgctggccctgatcagcgattcctacgaggaacacgacaaggaacgccgcctgtcggaccgctcgacgcggctgatggaagaggaactgcgcgccgccaaccaggaatcccggcgccaggccaaggcccacctccaggccattctgaacaccgtgggcgaaggcatcgtcatcgccgacccgaatggcgccatcgtcagcgtcaaccccgccctgctctccatcttcggctacgagcgcgacgaggtgatcggcaagaatatcgacctcctcatcccctggcggggctcaagggggaggcggtcagcggcatgaaccgcatcttcgccctgggccgcgaaagcatggcccggcggcgggggggcgcgtcctttcccatcgagctggcggccggcgacctgacgcccaccggatcgccgcaattcgtggtgatcatgcgcgacatctccgagcgcaagcgcatcgagcgcgagatggccgaaagcgaggaacgcttccgcgacttcgcccaatccacctccgactggttctgggagatggggccggacctgcggttcaccggcttttccggccagttcaccgagcacacccgcaccctgcccgaccactatgtgggccgcacccgcgacgagatgatctccgacgacacccccgcagaggtccgccggcagaatctggccgacatggccgcccggcggcccttccgcgacttcgtctatcacaccagggagatggacgggccgggccgctttctgcgcgtcaacggcaagccggtcttcgacgcctcgggcgaattcaccggctatcgcggcaccgcgtcggacatcaccgaggaaatcgaggccgaggagcgtctcaaggccagtcaggccgagatcgagcgtctggccgagcgcaacaattccatcctggaaagcgtcgatgacggcatcgtcggcatcgacctcaacggccgggcgaccttcgtcaaccgcgcagccgccaagctgctggatttcgagcccgccgaactggtgggcagcgacattctgccgctgatggctctggacctccatacagccgagaagctctatcagatcctgctgcgcctgaccgagtccatccgcgacgacaccgccagcttcaagcgccgcgatggctcgcccctgccggtggagtacatcgcgtccccggtcatggacaggggcaaccaggtgggcgtggtgctgggctttcgcgacatcacccagcgccggctggtggaacgccagctgcgcgaggccaaggaggccgccgaggccggcaaccgcaccaagtcggaattcctggccaccatgagccatgaaatccgcacccccatgaacggggtgatcggcatgaccggcctgctgctggacaccagactgtccgaggaacagcgccatttcgccgagaccatccgggattcgggggaatccctgctgaccgtcatcaacgacatcctggacttctccaagatggaggcgggcaagctcgacctggactacaccgagttcgaactggtgcccctggtggaaagcgtggtcgacatcctggcgccccgcgcccatgccaagggcatcgagatcgccagcctgatcgacccccgcctgcgcatgctggtgcggtcggaccccggacggctgcgtcaggtgctgatgaatctgggcggcaacgccgtcaagttcacggaaaaaggcggcgtctccatcgaggtctcgctgctcgatggcccggacgctccggccatggcgcgcttcgacgtgcgcgacaccggcatcggcattccacccgaggctcagggccgcctgttctccatgttctcccaggtggatgcctccaccgcccggcgctatggcggcaccgggctgggcctggccatttcccggcgcctggccgagctgatgggcggggaggtgggcgtggaaagcgccgtcggccggggctcgcgtttctggatcaccctgccgctggagctgctggcgccgcaatcggcggcaccgcccgacctttccggccaccgggtgctggtggtggacgacaacccggtgaactgcgacgtcatcgaacgccagctgcgcgccttcggagtcgaggtccatgcctgcctggatgccggctcgggcatgggcgagttgacccgcgccgccgccatgggaaccccgtgggaggtggcggtggtcgattcccagatgcccgtggtgaccgggtccgagatggtgcgcatgatccacgccatccccatgctggccggcacgcgcatcgtcgtcacctcgtcccaggggatgcccgccgaccaaaacgacggccagcccgccatcgacgccttcctgcacaagccgctgcgccagtcgactttgctcgacaccatcggccgcgtgctgggcctgaccggcccggcggagcggcccgccgaccacgccgaggaatacaaggcctcggaacccgccgccaagcggctgcgcatcctggtggccgaggacaatcccgtcaaccagcaggtggcgctggggctgctgcgcaagctgggccacaccgtggacgtggtgggcgacggcgccgaggccctggaagccgtccgcctgctgccctacgacgtggtgctgatggacgtgcagatgcccgagatggacgggctggaggcgacccgcgccatccgcgcccttccccttgccgccgcccaggtgcccatcgtcgccatgaccgccaacgccatgcgcggcgacgaccagatgtgcttcgacgccggcatggacggctatatctccaagcccatcgaccggcacaagctggccgaggcgctggccaaatattccggcgcccccgagaccaagccagccgagcccccggccgctccccagaattccaaggcggtggaccgcgatgtcctggacgccctggccgccgatatcgaggccgataccgtggtggaaatcctggtgaagttcatggaggacgcccgcacccgccagaacaacgcggcggcgttggctcccacgggcgacctggaaaaggtccgccgcgaagcccacaccatcaagggcgccgccgcaagcctgggcctgctggcggtccgcgacgcctgcctcgccctggagcaggccgcccgcgccggcggcgaggtggccccccagatcgaccggctccaccaggatatcgaggccctgcccggccttctggccgccaccccctacgccctgccggccccttgaggacgcgccatgatcgccctgctcatcgatgacaatcccaccaatctgatgctgctcaagcatcggctgatcaagatcgagggctgcgaggtggtctgcatggaatcggccctcgacgccctggcttggtgcgaggccaacacccccgacatcatcctcaccgattacatgatgcccggcatggacgggctggacttcatccgccaggtgcgccggcgcgaggagatgcaggatgttccggtggtggtggtcaccacctccgacgtcaaggaaatccgccagcaggccctggacctgggcgcggccgacttcctcaccaagccggtggacgggccggagctgatggcgcggacccgcaacctgctggcgctgcggcaatcgcgcctcgccctgcacgaccgcgccgccgaggaactggtgatgcggctgtccaaggcggcggaatatcgcgatccggaaaccggcgcccatatcgagcgcatggcccgctattccgcgctgatcgcccggcggatgggattgcccaatgaagcggtggagcgcctggaactggccgcccccatgcacgacgtgggcaaggtgggcattcccgacatgatcctgctgaagcccgaccggctgtccgagaccgaattcaccatcatgaagcagcacgccatgtatggctgggagatcctgaaggacagctcgtcgcaactggtgcgcctggcggcgctgatcgccaggacccaccacgagaagttcgatggcagcggctatcccgaagggctggccggcgacaagatccccctggagggacggatcgtggcggtggccgacgtcttcgacgccctgacctcgacacgcccttacaagacgccctggccggtggacaaggcggcggccttcctgggcgagcagaaggggtgtcacttcgacccggcctgcgtcgatgcattcctgtccgatctcggcgaggtgctgcgcatcaaggcgcaattcctcgatcacggcgacgaggcgccgccccaccccctggccgattactgaaggctgggccgatcccccagcggcagccgtccctcggccgccagaacgcggcaggcatccaccaccgccgcgtcgaacagggtgccgctgtgggcgatgatctcgcgcatggccgcatccaggcccagggcggcacggtacggacggtccgaggcgatggcttcgaccacgtcggccacggccagaatgcgggcctcgaaaaggatctcgtcccccttcagcccgtcgggatagccgcttccgtccatgcgttcgtggtgatggcgcaccatgtcggcgatgggccagggaaagtccacgccgttgagaatctcgcagccatcggcggaatggttgcggatgatgtcgaattccagggccgacagacggccggggcgggtcagcatctcggccggaatgccgatcttgccgatatcgtggatggtgccggccacccgcaggcccttcagcgtctcggccggcaatcccagttgccggccaatggccaccgcgatctcggcgacccgccgctgatggccggcggtatagggatcgcgcacctcgatggtggaggccaccgcctcgatggtgccttccagggcacgctccagcgccgcctgggcccgctcgccatccttgatctggcgcttcaggtcgccggtatgcaccagcatgcgcccggtcagcgggcgcaggatcagcacgaagccgaccatgccgaatcccaccagcaccagggcgccggccgccaccgacaggaccagctggtcgatattgctgtgcagttcggccagatcctggcgcaccatcacgatccagtcgctgccgggcaggcgctgggacaggaccacgtcgggcacggcgccgggccgggtcagatacaggggctcgggatcgatcgcggcccgcgagaacgcctcggccacctcgtcatccccccccgcgctcccgtcgcggcggggaaagaacacctgggcgcccgaggccgccaggcgtccgagaatgatctctccggtccgccccagggtttccacgtcggcgacgatggcacgcaggccctgggcgtcgaacagcagcaggtcgtgaccttcgcgggtgccgtcgcgccccaggatcggcgccgagaccagcaggacccagcggccgtcgatcagggtgggtgcccccagggccgggggctcgcccgcctcggggctccacagggcgggaggaacggacgcccccaccgacaccagcggacgataatcccggccgacgcgcaggatgcccagcatgtcgcgcgacagcttcatggaatcgccgagtttgtcggcagtgaaagcctgcagcttgtccaggctcatggcgccctggttgtagctgctcaaggcgtcgcggatgacgctgcggctggtcacctggcgggccatgtcgcccatgcggtccaccgtctcgcgcagggcggcgacctggaggtccaggccgtgctccagggcctggtccgccgaacggaccatctgccggtgcaagggaatgatggcggccagggcgacgcccaatccaacgacggccatggccagcactgcgtagacgatgatattgcgctgcagtttgacagcgtcgatgacctgcactcgaaccgacctccacctcgtgatttgacttctatcaaatcacggccggaaaacgcaatgactacaggaaagacccgatcgccgccatgaagccggacgggttgtcggcatggacccaatggcccgcgcccgggacttccacggtctcggcgcgggggaagaactgggcgatcacgtcctcgtgcgccggccggatgtaatccgaggtttctccggccacgaacagggtcggcccctcatagcaggcgccgtcgggaaagggcggaaaggccaggatgtcgtccatatgggcgcccagcaccgccagattgggccgccagcgataaccgccggcgccgccctccagattctgcatcaggaaggcgcgcacgcccttgtcgggaatggcggcggccagggcggcctccacctctccccgcgacgagatctcggccaggggcacgccgcgcatggccttgatatagggggcgaaggtatggctgtaggagaccggggcgatgtccactaccaccagccgctccaccatgtcggggcgggtcagggccagggtcatggccgccttgccgcccatggaatggcccatgaccgccgccctgccgcccaggtgatcgatcacggccgccagttcgcgggccatgaaagggtaatccatgatctcggtccacgggctggcgccgtgattgggcaggtcgagagccagaacccgccgggtctcacccagggtcttgaccaccgccccccaattgcgggccgagcccaacaggccgtgcaggatcagcagcggcaccccatggggagcgccgtgaccggccgtgatggcgtgaagccgcatctagtgcctgaacagatgggaccggccgaccagcagccggccgatatggcgccccaccaccttcatcagcgagaaggtgggacggacgaactccaccgccacccagtccggccccagggcccggaccatggcgacacccttggccagcgggttggggtcctcgtaggccgagcgcagttcgaaggtgaagcgatagccgtggttgagcaggccgggcggccgccggaacttcaacccgccgatggagatgtcgacgacctcgaccaggatgccgtcgaacagcatgaacaggccttcgccttcgtgacgatcatcgacgcgtcggtcgttgctggcggacttcacgagcgcttcccctgcggatggactggacaacagtctagcaggacatggcgggccgcgcatccatcctgttgacggattccgccgaggcaaaataccccggggaaagaccctacgagaaaaccactagaaccaaggtatggtattaagcccttggttgatttcaattttatggagtttacgaaactcataccaacactggggttactccccccaatgcacgccactcgggcagtcttgaaatgactataatttgttcacttcgaattttccggaaattccggcgaagcaacaccaaaagcccccccggagtggaaacaccatgaacaaccagatcacccccgtcaccgtgaccacgtcccagaccctgctgaaggccgccatggccgatctcgagcgggcgacccccaactcgcgtccgggcgacaaggtttcgctggtggcgaatcagtggcaggacaccttcatcatgacggcgcgttatggctggctgcggctgccgcactgatcgcggaagcgggcgccatcggccacgggcgatggcgcgccctgctgggctcgaaccagcgacctgccgcttagaaggcggctgctctatccaactgagctaagggcgcccgtcgccgccaggagaggccgctcgggagcgccgagcctcaaatatgaggcgcggcgctcatgcgaacatgaagcgagcggccaggggcgcagaggcgcccgcaaaggcagagggcaaaacaaacaaagctaaagagtgatgcacgttcaaggcatcacgcttcagaagcggccgaactccagcttgtcgaagcggaaattgtcggcgtagttcttgggcttttgcaggcgggcgttttcggtggccacctgatagtccaggcccttcttcttcgcgaaggccacggcctcttccatggtggcgaacttgacccgcacctgcgacgaggtgtcggtcgaacccagccagcccatcaggttgtccgcctgcttgggagcggtcggctcgtattccagaacccaggacttggcgttgccgttgcggccggactgcatggcggtcttggccgggcgatagatgcggacctgcatcaaagtctctcctgctcgtcaaaagccctggttgcgggcggggccttaaaaatcaaggggttggcaccccccgtcggatcccgcccgcaaggtataatggacgcctcgcgaatccgcaagaacctacagcttgaacaccgtccgaaggcccagcaccgtggcgtccggaatggtcttgcgggagttctcgggcagggtcgtggtgccgcccggatggatgacgtattgggcgtcgggcaccagcgtcatccagggagtcacctgatagcggtaggtcagctccaccgccgcctcgtaatcgtggtccggggcggtggcggtgccgaaccgccgggcatcggcatcgcgcgcggccagggacgagctcatggcgccgaaggcgaagcccacggccaccacgtcgtcgtcgcggccctccagcggccccttgtagctgaggccggtgtcgacatagagcggcatctggttgcggtcgtcgggcaggccggtgacgcgcaggaaggccgacaggcccaaatcctcggtgccggcttccttgtagagcatgccgtcatagatgccgtagatggcccagttgccgcgatgggtcttggcggcgccggcggcattgctgcccagcgagacgccggcaatgtcatagcgctggtcggtggcgcggccgttgtagtaccagccgcccagcttgaacatggtgggcaggcccgccgcgcccttggcctggttcaggccgtactgggactcgaacatccacatgggcgcctcgtcgacggtatagtcgattccgctgcggttccgcttctgggcgtcgttgcccacattggtgccgggcgccacgttgcccgtgaacacgcccgcctgcaccgccaggtcctcggtggcctggaccttgaggcgggtgcccaggttggacaggggatagccgccgccgcccgagggcaggttggcggcgaaggccggcggccagccgaaggcggaattgatcagattggtggcgaccacggagttgaagaactcctcctgcatgggcagctggccgaagcgcagcgacaccttgtcgtcgagcacgctctgctgcagccacagggagaacagccgggtcgaaggcgccgcctcgatgtcgcgcaccggaatcaggttgccgatgaaattggcggaaagctggcggccctgaatgtgcaggccggtaacgtggaaggcgccacccttccagcccaccgcctgttccaggtcggcatccacatccacctgcaacagggcattgcccacggcgcgacgcttgatgccgcccgaggcgttgcccagcatttcggccgtgtaggcggcgttcaccttgacgcccttctcggcaaggtcggtgcgcaggccgccccaatcaccggtcagggtctcgcgctcccaaaagcccttgggagcaccctcggcttcctcggccgacgcggcggccgatcccaggccaagaccggcggcgacggccagccgggcaacgaaaattcctgtcttcatggcaaaatccacccttcgaagatgcggcgcaggtccacccacctccgggacaccccgcccggggaagcgcgcgcacgcgacagcgatggcaggtctcctggctcgcgggtcaaaggatcggcgccccagccttcccggttcgaaacggcccccggtggtcgtcggggccgaaaccagtggcttctcaaaacgggcgcatcctctccgcatacagttgcgggggcagccgcgggttcgggaggaaacagcccctgaccgcgttcccttttcacctctgcccaccccaaggcaagcgagaggaaccatcacgacgaaggtttacccgcacccgattcccattgcaaggcggtgttttcgcctgacatctagggctgcctccgtgggttggattggaccttcccccaggcttaggttagattccgcccgcagcggggggacggaaaacgaagcggacgaatatggacggaacggattcgcagatgacacccgcatccaattccgacgaggacgccacgccacctcctgtctccgaggggggctggctgacggtcagcgaagccagcggcacggggacgtcctccggcggagggctgcttgggccgctgcggcggggcttgggccgcctgaccgccagttggcgttacctggccgacccggccgagcgccacgccctggtgcagcagatgcgcggcggattggcccgattgacccattcgttccagcgcccctccatggccgccagcatggacgtcgcggctccgcccacggttctgccttcggacaagtccgaacccgacgaggtgccgcccttcgacccggaagccgccctggcccggctgcgctcggccctgcggcaattgcccgacaagggcgaggtgatcgtccccggcaatctccaatccctggaccggctgcttgccgagccgccgccggccatggatttcgaggccgccgacctgctgcacgactgtttcccgcgcgggacgcggcattcgggcaaccgggtcctgctggcggtggcccgcaacctgacccgcaatttcggccgccccggccggctgcccatgaccagcggcaagtcctggaccatgctcgacccggcggtcttcgtcgatcagatggcggcgcagctggccgagatcagcgacttcgtcctgacctggcaggcacaggagaagagcttcctgatcctggaattcgccgaggtggaattgatcgaatacctattcgagcacctccacccccgccgccacggcgccctgctgatccaggtgatggatttcaaggtgctgtccacccgccgcgccgggctgctgcgccgaattccggcgcgggttcgccgcttcgtccagcacacggcgggcgcggacccgtctgttcccctggcctatgcccgagacacggccaagctgctcgagctcatggagcagcgggtcttcttccggccggtagtcgaagccgccgccgccgcacgggccgaggtggagaaggtcatcgagcggctggctccccccgccccggggcagccgtcgctttccctcgcccccggggggcgcccggccgaggccgggtccggcctgggccagatcatgcaggcggtgggaccgaacgcgccaccggcggcgcggcccgcgccgccaccaccggcgagcgctacgcccgccgccatggtgtccgccgcgccggccccatctcctccgacccaggccgtctccgtggtggcgcccccacgccccgccggactgcccgtgccgacggtgccgcagcgcaagcggttctccaaccgcgtgaagaccgaggccgtgatgcgggtcctggccggggagagccgcgagcaggtggccgccgccctgggcgcgacacccgacctgctggaacgctggctggattcctttctcaacggcggtgccgccgccctggcccccaaggccaaggcccaggccgccaagccggccagatcgtcccgttccaagggccctgcccccgtagaggcggcctccatcgacgacctcaaggccaagcttcagtccctgctgcagaccgtagaagtgctgagcacccagattcacgccctgccggccgaagacaaggcgccgccgcccgccctgcccccgcccgccgctccccggccggcagtggccccggccccgcgatccgatgggacggcgtcgccccctcccggctttcccgcggaagaccccgacccgccgccccggctgaagcgcagccgcaccccgcgcccccgcggctgagcaccggcgcccccggccggcgccgacccgggagggcctattccggcatatgccgccgaataagtgtcacatggcgatacaaacacctcttttcggacactttggtctctggacatcgtggcgacgcggctgaggcccgaccaaaggatcaacccgtattcgtaggtaaaaccaaggatttgcccccctgttcttttgaataatttccacaagatccttatgccttacggataagcccaatcggacggatgacgaaatatgacgccgcccacagcccctcaaagcggcttcatccttggagtccatagccacggggacgatctcgccccccaagtccgaaacacctcgtcacatagcgcaacgacttgttattgtacgtaacgcagtgtttatgattttcctgtcgaaatcattctggaggcgtgaccccaatggcgcggatcgcggtagtcgaggacgaagctcctcttcgggcggatctggtcgagtatctttcggcgtgcgggcacgatgtgatcggctgcggcgacggcaaggagcttgaccgcgccctggacgaacaccccgtcgaaatcatcattctcgacatcaacctgccgggcgagggtggattttccatcgccgggcggcttcgctcccattccgacgtcggcatcatcatgctgacggcgcgggggctgaacgtcgaccgggtggtcggcctggaagtgggcgccgacgtctacatggtcaagccggtggaactgcgcgaactggaggcccaggtccgcaccctggcccggcgcatgcgggtgtcgcagccgccccaggtcccgtccgagatccggccggctgccgatgcgcccgccccgccgccggccgctccggcggttcccaccgagtggatctatgaccagctgacctggacgctgatcgcccccgacggcaagtcggtcaagctgaccggcaacgagcgggtgttcgtctcgctgctggtgtcgcggccgggcgagccggtgtcgcgcgacgagatcttccgggcgctgggcaagcgcggctgggaccccgccgaccgttcggtggattccatggtgcggcgtctccgggccaagggcgaccagtccttcggccatccgctgcccatcgaatcggtgcacagcgtcggctacgccttcgcggcgccggtcggtctcagatagtcaatggcggagccgcgcaaactttcgctcaggccgcgcggcgattcttccgtccacgccccagcggctccgccctggccggtgctgatcgtcgacgacgacgagcaggtccatcagatgacccaggtcatcttgcgcgacctgtcctatcagggccgcccgttcaagtgcatcgaggccacctcggccgccgaggccgccgccatcctcgacctgcagccggagattccggtggtgctgctggacgtggtgatggagacccccgatgccggcctgcgcctggtccgccatatccgcgaggaattgggcaaccgccgcatccgcatcatcctgcgcaccggccagcccggcgacgcccccgagcgcgacgtggtgctgggctacgacatcaacgactacaagagcaaggcggagctgaccgcccagaagatgttcaccgccctggtgggcgcgctgcgggcctggaacgacatcactaccatcgagcggctgaatgccgagctgaccgagctgaacgcctcgctggaggtcaaggtcgaggaccgcaccgccgatctgcgcgagagcaacgaggccctggcccgctccaagacccgggccgagaccgccctgctgcgcgagaccgaggccaagagccagttgcgtcaattcctgtccatggtcagccacgaattccgcacgccgctggccatcatcgattcctcggcccagatgctgcgcatccgggtggagaaaagcgatcccggcagcgtcgcccggctggacaccatccggggcggcgtccagcgcctgctgggcctgatcgacacctgcctggccgacgagcaactggaaagcggccgcatcgtcctgcacgaaaagtcgttcgacatcggccccatgatcgaggtcaccctgtcccattaccgggtggcctcgcccacccaccgctactgtgccgaatttccccccggcctcgcggtgtggggcgaccccggcatgatcgccctggtgatcaacaatctggtgggcaacgcggtgaaatattccccggcgggctcggacatcctggtggccgccgccgtggacggcgccgacgtggcgctcagcgtcaccgaccaggggatgggcatcccggaagaggacagggacaacatcttcgagcgctttcaccgcgccgccaattccaagggcctgcccggctcgggaattgggctgcacatggtccggcagatcgtcgagatgcatggcggcaccgtatcggtgaaaagccgcctcaagcggggctcctgcttcacagtgcggctgcgtccctctcccggcccgggggccgagggcatcgatccggtgcaagacggcttgagcgcccccgcccccgatgatacggtcgacgatcttggcgaaggcaacaggtagccggcatgcttgcgaaacattacaggtcgttcaaacacgaccttgaccagcgcggcatcattttctcgttctcgggctatctgtccgaggagattctgtattccctgggcaatgcgctgcgccagaagatgacgctggaggatgccaacgtcaccaccgtgaaaaaggtgttctcggtcttcgtggagcaggctcagaacatcatccgctattcggccgacaagctgtcgggcgacaagggcaaggccatcgagctgtcgtcgggcatggtgaccatcggcaccgaaaacgaccggttcttcatcgtctgcgccaatgtggtgctggccgccgacgagccgcgcctgcgcgaacggctggaactgctgcggtccatggatcgcgacgccatcaaggcgtactacaaggaacagctgcgcgaggcgccggaagaacagagcaagggcgccaccatcggattgatcgagatcgcccggcgtgccagcgaacccatcgagttcgatttcgatcccatcgacgaccagaagttcttcttctgcatgaaggtatccatctgaggtgcttatggaaaacttgacgatcgcggcaacggagcgctcgcccgccgtggatttcgatttcgccgccgggcgtctcagcctgaagggcgaatcctatcccgaggacgcatcggccgtgttcggccccatcttcgccgccctggagaccttcctcggagccgccggggaccgcgaggtcacgttcgatttcgaactcatctatttcaacagctccagcgccaaggcgctgatgaacatgttccagatgctcgatcaggcggccggagccggctgccggctccaggtcaactggttctatgccgccgacgacgacaccatgaaggagttcggcgaggatttcagcgaagacctcgatcacgtcggctttcatctggtggcggtcgagtagggccgttgaacggtttcaacctcttcgacgccgaggagaagagcctggagcaggccgaggacctgcgccgccagttggagcaggcccccgcccccgtccgggacggcatttcctcgctggtggaagcctaccgccgctcggtgcgcgaacagcgccgtctggtccgcgtgtcggaccgcctgcaggcccagctggccacggtcaaccaggagctgggcaagcgcaaggccgaggccgaggacgccctggaagacctgaaggccgcccaggaatccctggtccaggcggaaaagctggcctcgctgggcgccctggtgggcggcgtcgcccacgagatcaacacgccggtgggcatcgccctgtcctgcgcctcccatctggcggattccaccggggccatgcgcaagctgttcgaggccgacgacatctcggtcgaggatttcgagcgcttcatggacacggtgaaggacaccaccggcctgatcctgaccaatgtggagcgcgcggcggaactgatccgcagcttcaagcaggtggccgtggaccgcacctcgtcggagcgccgccgcttcgatctggccacctatatccgcgagaccctgttcagcctggggccccatctgcggcaggcgggccatacggtgcgcctggactgccccgagggcatcgtcatggacagctatcccggcgccctgtcccaggtgctgggcaatttcgtcatgaactcgctggtccatggctacgagccgggcgagctgggcacgctgtccatgaccgtcgagcgcgaaggcgccgaccaggtgcgcctgacctatgccgatgacggcaagggaattcccgaggacaatctggggcgtatcttcgaccccttcttcaccacccggcgcggcagcggcggctcgggcctggggctgcacatcgtctacaacctggtgaccggcccgctgggcggcagcgtcgccgccgaatcgcccccggggggcgggacacggttcacggtgcagttgcccctcagcccctggagtgcgtcagctttaagctgaagcactccaggattttgtctgtacgaaaaagctccgctttttcagggctcaagcaccgctcgggcttaagagttcttcgacgttccgattcagcttaagtgcgaagaactctaatccttcgtcacactccggctcaatgcgggggtggcacgaccaatggacagggtggaacatcaagtccatgagcaagagtacggacgacagaaccaagctcagtctgcgccgggccacgcgcccccgggaggccgatggcgccgccccctggccggtgctggtggtcgacgacgacccggacgttcattccatgacccgggtgctgctgcgcgatttcagtttccagggcaaggggttcgaggtcatcagcgccatgtcggggaccgaggcccgcgccgtgctggcccggcgggccgatatcccggtcatgctgctggacgtggtgatggagacccccgacgccggtctgtcgctgatccgccacgtgcgcgacgacctgggcaaccggcgccttgccatcgtgctgcgcaccggccagccgggcgaggcgcccgagcgcgacgtcatgctcgcctacgacatcaacgactaccgctccaagaccgagctgaccgcccagaagctgttcacctcgctgatcggcggattgcggtcgtggatctatctgtcgaccatcgaggccatggcctcgaccctggaacgccgggtgaccgaacggacctgccagttggacgaggcgcggcgcttcgccgaaagcctggtggaactgctgcccaatcccttgtggttcaccgaccccgacggctcgctgcggctgtacaaccgcgccttccgcgagatgttcggcgtggattccggagattggcacggccagcccacccatggggtgctgccccagccgctggccgggctggaccagatggccgatatgagcctgaaggtgggtgggccgggcggattggccttcgaggcctccctggaccatcaggacggacagcggaccctggtggtgaacaaggggctggtgcgcagcgattgccgcggcacggcggacgagcccatgggcaccatcggcatcgtcaccgacatcaccgagcgcaagcacatggaaagccagctgcgccatctggccaccaccgacgagttgaccggctgcctcaaccgccgggcgttcttcgtcgccgccgagcaggagctggagcgggccagccgctatggcaacgccgtttcggtgctgatgatcgacatcgatcatttcaagcaggtcaacgaccgccatggccacgccgtgggcgacaaggcgctgaaggccgccaccgccgccatccgcgccaatctgcgcgaaatcgattcgttcggccggctgggaggcgaggaattcgccgccatgctgccggaaacgacgctggccggcgccctgctggtggccgagcgcctgcgccaggcggtggaagccatcgccctgccgctgggagacgatcagccgccgcttcgcctcaccaccagtctgggcgtcgccgagcgccagccgggcgaggtcgccgtggaccaggttctggcccgcgccgacacggcgctttaccgcgccaaggccgaaggccgcaaccgcgtcctggcctgaaggccgtcaacacccctttcccatcccgcctacgtagggcatagtgcacaaattgtgacctattgtagcggaggggggacgccgttgctgagagcgtatctcgtcatccttggcatgctgatggcgcttcccgcctgggcggggcaggtcgtcaaggtgggaggctacgagttcgcccccttcgtcgagatgaacgcggcaggcaagcccgacggtctggccctgcgcctgatcgaggccatgaacgcccatcaggaccgcttcaccttccagttcgtccccacctcgcccaaccgccggtacaaggatttcgaagccggccagttcgacgtcatcctgttcgagagccccgattggggctgggtcgagcgcaagctgccgatccagccctcccgcgtcttcctcgacggcggcgagatctacatcacccaggccaagccggggcgcgaccagggcttcttcgccgagctgggggacaagcgcatggtgggcattctcggctaccactacggcttcgccgggttcgaggccgaccccgccgttctggcgtcgcgcttccgcatggccctggtcaacgacaacgccgccagtatcgagatgatcctcaaggagcgtggcgacgtggcggtggtcaccgatgcctatctcaagcgctggctgcgctcgcgtcccgaggcccggagcaggctgctggtgtccgagcgcttcgaccagcgctatgcccaccacgccctggtgcgcgccggcggcgcctttaccgccgccgacatggaccgcctgctggacgccatggacaaggacggcaccctggcggggctgtggcgcaatttcggcatcaaggactgaagcggtcatgagccaggcccgatcatgagccaggacggaacgccttcctcccaggacctggcgatgggccggggcctggcggtcaagatgttcgccgccaccatgccggtgctggtgctggttgtgctgctgacccaggccggtctgggctggatcaactaccatgcccggctgggggccctggccaaccgggccgacctcatcgccaccctgaccgcccaagccatcgcccggccgctgtggaacctggaccgtcccatctatcaggcccaggtggaggccctgaccagcgaccccggcttcctgcaggcccgggtcctggacgagaccggccagccggtcctggcgctgggaagcgccccggccgccgacggaacctcgctcacggtcctcaagccggtgatcgagcccggcggaaccaagaccatcggcaccttcgaactgaccctgtccaaggcagaactggaaaaggacgaccgcatccagatcggcctgggcgtcggcaccgtcctggtgctgctggtcaccgccttcgccattttgcacaacgccacccggcggctgatcctcggcccgctggggcgcctgctggacgccatggcccgggtggagcgcaaggactggacccaggtcgggtggagcagcggcgacgagatcggccgggtggtcaccgccttcaaccacatggtcgacggcctgcggtcgggcgacgaggccaagcgcctgctccgggagctggagattgcccagtcccgcctgatcgagaacaatgccgccctggaagccgccaatcgcctggtgctcgacagcatcggctatgcccgcaagattcaggacggcctgctgcccgacgcctccaccctgggcgattccgtgcgcgaattccatgtgagctggaacccgctgcagcaagtgggcggcgattattactggctgcaccgcctggggcggcgcgccacccttctcctggccgattgcaccggccatggcgtgcccggcgccttcatgaccgtggtggtggccaccgccctggaccgcatcctggtggaaggcggcgagatgctgccctcggaaatcctgtgccgcctggacaaggcggtgcgggaacgcctgcgccaggaccgccccgacggctcctccgatgacgggctcgacgcggcggtctgcctgtgggacggggaaacccagaccctgaccttcgccggcgccaatctgcccctggtcacctgccgcgacggccagatcggcgtggtcaagggcaaccgccacagcctgggctatcgcaccggcgccaccccgcaatccttcgacgaccacgtcctgcccatggagcccggcaccgccgtctatctcttcaccgacggcatgaccgatcatgtgggcggcgagccgccccggctgtacggccgccggcgcctgctggacctgatccaggccacctcccacctggcgctgcaccttcaggtggatcgcatcgagcaggccctggccgagcatcgcggcgggcaaaaccgccgcgacgacatgaccatcatggccttccgcccctactgaccggttcgggagattgcgccgccggccgcattcggcataatggtaccttaatgccattatgaggaccgccatgcgccaccgccatctgctgtcgcccatcacgttccggggggtcacccttcccaaccgcatgatcatgggctccatgcatctgggcttcgaggcactgcccgacgcctggtcccgtctggccgagttctacaccgagcgcgccaggggcggcatcggcctgatcgtcaccggcggcgtggcgcccaaccagcaagggcggttcggccccgacggcacggtgctgacctccgaggccgagcttcccggccaccgcctgatcacccaggcggtccacgcccagggcgggcgcatcatcatgcaaatcctccattgcggccgttattcccgcatgaaggacatcgtggcgccgtcggcgatccgtgcccctatcaacagccaggccccccgcgagctgtccgatgccgagatcgtccagaccatcgccgactatgccgaatgcgcccggctggccgtgctggcgggctatgacggcgtcgaggtgatggcgtcggaaggctatctgatcaacgagttcctggcgctccgcaccaacaagcgcaccgaccgctggggcggcgacctgcacggccgcatgcgtttcctggtggagatcgtccgcgccgtccgcgccgccctgggcgaggccgccatgatgagcgtgcgcctgtccatggtcgatctggtggaggatggcctggccgccgaggaggtggtggcggtggcccgggccatcgaggccgagggctgcgacctgatcaacagcggcatcggctggcacgaggcccgggtgccgaccatcgcccacaccgtgccccagggcgcctggagctgggccaccgcccgggtcaaggcggcggtcggcattcccgtggcggccagcaaccgcatcaagactcccgaccttgccgaatccctgatcgccgagggccagtgcgatctggtcagcatggcgcggcccctgctggccgaccccgccttcgccgccaaggtggcggcgggcgagcccgacagcatcaacgcctgcatcggctgcaaccagggctgcctcgaccccatcttctccggcggcgccgccacctgtctggtcaacccccgggccggacgcgagggcgagttcatgtcccgccccccctgcgagacccagcgcgttgccgtggtgggcggcgggccggcggggatggcctgtgccctggacgccgcccggcgcggccatgacgtcaccctgttcgatgccgccccggagctgggcggccagttcatcctggcccgcgccgtcccgggcaaggaggaatacctcgccacgcccagctattacgcccaggccctgaagcaggccggcgtgacgctgcgcctgggccatgccgccaccgccgccgagttgctgcccttcgcccgcatcgtgctggccacgggcatccgaccgcgccggctcgacctgcccggcgccgaccatcccaaagtggtgggctacgaggacatcctgtcgggccgccagcgggccggcgcccgagtggccatcatgggctcgggcggtatcggcttcgataccgcgctctatctggtgggcgaggacttcgaggccgacttcaacgccgaatggggcatcgaccgcgccttcaccggacgcggcgggctggccgagccggtggccccaccgccgccccggcgcgccgtcaccatgctccagcgcaaggctgatcgccccggcgccggcctgggcaagaccacgggatggattcacaaggcccatctccagcgccaccatgtggacatgctggccggggtcacctaccgcttcatcgacgatgccgggctgcacgtcaccatcaacggcgaggaccgcctgatcgaagccgacaccgtggtggtctgcatcggccaggagccccgggacgatctggccgaggaattgaaggcccagggccgccacgtccatctgatcggtggcgcccgcgatgcctccaggctggatgcgctggcggcgttcgaggaggggacgcggttgggactggcgctgtgatcattgggctatcgcccaagcccatttggggcgatgccccaaaccccctttattttcagaaataagggaggtttggaggtttcctccaaccggggtcggggcgggagccccgcgtcagcctctacacgctcatccccgccacccaacccgacgaccacgcccactggaagttatagccgcccagccagccggccacgtccaccgcctcgccgatgaaatgcaggccgggatgggacttggccgccatggtcttagaggacagcccggcggtgtcaacgccgcccagggtgacctcggcggtgcggtagccctcgctgcccgccggaaccagcggccattccgacagcaggcgggccagcccggccagggcggcattcgtcgactgaccgatcggtcgaccgagcagaccggcccgctccgtcagggcgcgggccaggcgggcgggcagcaattcgcccacgacggtctccacctgggcattgggccgggcggccttgcgctccagcaggcgggcattggcatccaggtcgggcaacagattgaccatgatcggctgaccggtcagccagtatgaactgatctgcagcaccgccggtcccgacagaccgcgatgggtgaacagcagggcctcgcggaagcgggtcttgccgaagcggagttcagccggcacggcgatgcccgccagatcacgcatgaggtcgagatcggccccggtgaaggtcagcggcaccagtccgggccggggaggcaccaccgacaggccataacgcccagccagggtatgggcgaagccggtggcgccgatcttcggcaccgatagcccgccggtggcgatcaccagggcgggggcgcaatagccgccccggctggtggccacctggaacggcccctcgccggtcaccgcgccgagtttggcctccagcaccacctccaccccgcccgcgccgcattccgacagcagcatggcgacgatatcggcggccgaattgtcgcagaacagctgcccgtgctcgcgctcgtgccaggcgatgcggtggcgcttcataaggtccaggaaatcggcggggccgaaacgcttcagcgccgaggtggcgtaatggggattggccgataaatactgggccggggtgacggtgcggttggtgaagttgcacttgccgccgccggagatgaggattttcctccccggctggtcgttgtggtccagcaccaccacccgcttgccgcgcccggcggccacggcggcgcacatcagcccggcggcaccggcaccgatcacgatcacgtcgaaggcggaggaagaatggctcatggccggacttctaccccatccggtcgcgccactccagcaggcggtagaccgcgcggcccagggtcagtccgtcgcccaggcccgaggcggtcagatcggcatgggccagattgcccaggcgatagaattgcccatggggcaccgccgccgccagggactcgccctcgcccaccggcacgatgcggtcgtcggctccgtggatgaccagcagttccggcccgaagcccgagagatcgcgggcggcaaggtcgagccggccgatctcgtccccgatccccggcggcaggccgtccagcagatccgccacgcggccggggtcttcgttgtcgagcagcgccatgacggcgcggccctgcggccccagccgaggggtcagatcatcgatcgccacccccagatcggccatgcgccgccgggcgatggcttccagcagggtgcggtcgccggtatcggtcaggcgccgggcgttgctcagcacgaacacccacttgccataggcgttgggctccagcctttggccctgccagaagccagtggtgaagaagccgatgacgcgccgcgcgtcatagggcggccccaccgccgccagcaccgccaccttggccgccacctccggctccagggacgccagcaccgccggaatggcggcgtaggagatggcggccagggcgacccggtctcccggcgcatggcggatcgcctgggccacctcggcggcatcggcggccgacagggtcaacgccttggcgcccagcagatcgggcaccatcacccgccaccccgcccccaccagggcagcggcgaagcggaccagacggggatcgtccttgcccgccacggcggcgccgggcagcagcaggagcaccggcccggactggccataaagatcggcccttccacccggatacgccacggcttgggcggcgacgaatgcgggcgtgccgcccagggaggccaacaggcggatggtgtcgaaggcccggcgaccgggcggcgaggcgaggccgagaaccatggccagcaggacgacgagaatgaggactctgtcattccgacgacctgcgggaggaggaatctcatcctggaacggtctgtccgacattgaaacggtgctccaggtggagatccctcgctctcgctcgggatgacactctcaaacgaggcccgaccgcctcacacctcgatctcgcccagcttggcctgggtttccttcaggcggtcggccttcttcttcatgtcgtgttccatgcgcttgatgcgcttgtccaggtcctcgatatgggcgagacgctcctgccgcttctgcttgttgtagcccgaggcgaagcgcttgatgccccaatcggcggtcacgaagaacagggcggccccggccaccagcgtgaccaccgccgccacgccgccataggcgctgttgaccgccaccatggcgccccagaagccgatggtcaccagggacgaggccgaggccagcaccagccggttgaccgtctggtcatagcgcatctggcgcttttcatgctcgcgcatggcgttgacgatctcttcgcgggcgatggcctgccaggtgcggaacgacatgcccttgaccgtccggttatcgcggatggtctgttccagcttgcgcaccagataatcggctttctgttccggcgtcgggccttcggcggccaagtctgcctccctatgttggacgggggcagtctaatcaacccttatcccttccggaaagggccttcctcggtctggctcgccatatcctcggtcaccatggcgcgctcgtggacgaggtagcgggccaccggctcggccagacgggaatcggcgatccagtgggcggaataggtggcattgggcagatagccccggctgaccttgtgctcgccctgggcaccggcctcgacgcgggccagtccttgggcgatggcgaaatccagcgcccggtaatagcaggcctcgaaatgcaggaagtccacatggcgccccccaccccaggtgcggccgtaaagggtgtcgccacccagcatgttgaaggcggcgcccagcggctcgccgccgtcttcggcccagaccagcaccacgctgtcggccagggccgaggccgacaattcctcgaagaaggcgcggctgacataggcgcggccccatttgcggtcgaccaccgcctgatagaaggcgtgaaagacatcccagtgccgcgccttgacgtcaccgcccaccagggtggaaagccttatgccggtgcgcgccaccgcgtcgcgctccttgcggatctgcttgcgcttgcgcgacgagagttgccccaggaagtcatcgaagctttgatagcccgggttggtccagtggtactggctgcccaggcgctgaaggtagcccgcctcgcccaggccctcgtactcgtcgccgccgggaaaggtgacgtgcaccgaactgacgcccagccgccgggccagatccaccatggaggcggccagcacgcggcgcagcctcggaccgtcctcgccgggacggaccagcaggcgcggcccggtgacgggggtgaagggcacggcgcattgcagcttggggtaatactggccgcccgcccgttcataggcctgggcccagctccagtcgaagacgtattcgccgaaggaatgacttttcaggtaaaggggcgccgccgccagcaaacggccctcgccgtcgcgcgccgccagatggcgcggcgtccatcccgtctggggtgacgccgaaccggaacgctccatggcaagaagaaaagcatgccggatgaaggggttggctgtccccgcgcactcatcccactcggcggcgccgacctcggagatggcggacaggacggtgacggtcaggggcttgcttccatcgggcatgagccaaagatgaggtctttccggaagaattccaagatgcgcatggccgtcatgacgcatcccgccccttcggggagtatcaattcctgcccgggaaatgctatgggagggccgccccttcccgaaccctgcggatcatgagcgcttccatcgacttctcatcgctgccccaggccgagctgaccgacgacggcggcaagcccctccgggcccggctgctcgccacccacgacatcgccgcggcggtggccgaggcggtgcgcgccaattgggcggtgatgccggccggcggcctgaccagcgccatcggctcgtatgactacaaggacgaggagatccagggcttcgcaggcatcgtcgccatccgccccaagggcgccctggccgccgagatggtcggcgccgacacgccgctgaccgacctgaagacccatcaggtggccgtcgatgcggacaaggggctggtctcggccggcgccggcctgaccttcacccaggtcaacgccgccctggccgaagcggtcggccccaatgcccgcctgctggtggacctcaccagcatcggctcggcctttgtcggcggcgtggtggccaccggcggcatggggccgctgcgcctgtcgcccctgggcaccctcgacgccgtctgcctggccgatggcggcgatcaggcccgtctggtcgagggcgacgccctggccgccgtgcagggcctgcagggctggaccggcatggtggccgccgcccggttccgctacgtccaggttcccaccggcgagttcgggctggtcctgccggtgcagggctcggacgtggacaccatcgccggattgctgtcctggctgcggccctggacccggatcgccctgccgaccgagcccggcggccgcatcaccggcgagggcggcgagacggtgctgaacggcatcgagctggtcagccgcgattccctggaagccttcatcgaacattccgaggagcccgcccgctccaaggcgcaagggctgctgcagtcctgcgaatacgcgggcgccgacatgctggcctgcctgaccggctggtcggaattgtccatcgacgatgtgctgatgagccttctcgaccccgagaccgagaccatcggcggggtgatgatcgatttcggcgtcggcttctcgtccggcgccgagatggagaccttccgcgccatccgcgaaggcgcccccgatctggcccgcacccgggcgcgcgtggtccagccgggcaagctgaagccgtggagcacgtccaccgacatcaacatcgtgctgcccgccgataccggcgccatcgtcgccgtgctggaggcctatgccgattaccgctcggccatccgctccctggcccgcgagctgaagggcgcgctggaggtggagctgtcggcctatggccacctgtcgccgtcaggcatcgatccccaccaccgggtgacattggtcgcccccgagggggccgaggccgccctggccggagcccgtcaggcggtggccgccaacaagcgcaccctgatccacgacctgatgttcgccgccaagagcaacggcctggtggtgaccggcggggaaaagggcgccccctcgttggtggagatcgcccgggccgccggcggcgaaaaccgcctgcccgaggatctgaaggcggcctttgcccggacccgcgccgccgtgatggcggctccggcccatttcagcttccgcgcccccgccgaactgcgaacggccgactgatcagacgccgtccggccgcgcctccgtgggcagccagacatgcaccgtggtgcccttgccgggctcggattccagccacagcctgccgccatgaatcttggcgaccttcagggccgacgccaggcccagcccggcaccggggaaggtggagcgggaatgcaggcgcgagaacggccggatgatggtctgcaggtattgcggatcgatgccgatgccgttgtcgccgatgtcgatccgccacccctcgccctcggcctcggcggtgatcagcacctggggcgagacctccgggcgcacgaacttgatggcgttgctgatcaggttctcgaacagaatgaacagcagcaccggatcggcctgcaccacgggcaggtcaccgacccggaactggggcggattggcgccggaattggcgttgcaatcggcgatggcctggtccactacccggcggcaatccaccggcgcgaaagcggtcatggggcggttggaccgggtgtagtccaccaggcccttgaccagcaggctgagctggttggcgccttcgcggatgaaggtcatgctgctctgcgcccgctcgggcaattcggtcccgaattcgcgatccaggcgctgggtataggccagaatgtagcggatgggctcctgcaggtcgtgggacgcggcgaacagcatgcgctccagttcggccttggcctctaccgccacgtccgaactgtgcttttgcaaggtgacgtcgcggatggacgagcgcgagcccaggggggcaccctcgccatcgaaaatgggctgccacgacatggcgacccacaggacgtcgcccgccttgttgcggatgcggaattccatgtcctggccggactgccccctttgggcggcggacaggaactcgctcacctgcgggcggtcatcctcgaccaccaggggcaggggaaagccctccatcttgtggcattcggcgacgctgtagccggtcacccgctccaccgccggattgacccagcgcagatgcccgtcggtgtcgaaccagttctcccacgcataggtgaaatcggcgatggcgcggaaacgcttctggctgtcgtccaggtcctggatgcggctttccaccgcgctggacatggcattgaacgcctgggtcagcaaagcgatctcgtcccggccttccagcttgagccggaaggagaagtctccgcccgccaccttgagggaggcccgggtcagcatggtgagatggcgggtcagccaatagccgatggccgccagcaaagtaacggtcagcaccacctcggcaatggcgatgccgatgctctggtgcagcaattcacgtcgcgccgtgcccaggaagcgggtgtccaggccatagcgggcctcgccgtagcgctggcccagaaaggcgatgtcgaaggcgccctgatactcgtccagctcgggcgacagaaccttgtcggccgatggcaggggggcgtcaggcttgcgcccccaggcggccaccaccttgccggcggtattggtcaccaccatgtaggtgatgctcttggatgcgccccagccctcgatgatgctttgcagcgccgcgtaatcgcgctcggccaactggccggccagggtgatgttgtaggacgcctcctgggcctgcagccgcaattccgtgctgtcggacaggtgggtctggatcaggcgcacgctgttggtcaccagcagggtcagcatgaccagttccaccaggacgctgaacgccagcagacgaagccgcagcgagtgaaccggccggaccgatggggggcgcgcgtagccgaaagtcaattgctgctcctgctgttgctcccggccttctttaccatattggcatagggccgtgcctgctccatgtcggcggcggagacggggacaagccccttgaagccgccggccgtaaagaaggtccgcccccgatccgtattctcgaattcaccaagcgccgtccggatggcctggacggtctccgcccccagcctgggatgggccaggatgaactggtgcggcatgctgagacggctggaaaagaaggcaacacgctcccgcagatcctcggggatctgacgcatcaccgacccggaactgatggcggcatcggcgtcgccgatggccacggcccggatggcggtggaatgactggagacctcgaccagatcgtaatccacgccggcgcgcaggccgtaatcgacgaacagccaggtctcggccaccaccgatatggcggtcagacggtcggcggtcaggacgcgcttgccgcgcaactggcgcgcctcgcgcagggcgctctccttgggcacgacgatcagcggggtcagttccagcttgtagcgcgacagtggcacatagccgcggtcggcggcgatcaccccgaaatggggtgcggccaccagaacatcgaactcgtcggcggcgatatcgtccagataggcgtggaagctcccagaggtgtaaagctcgaccggacggccgagtgcctgctgcagatgctggcgcaacggatcatagagcttgagcaggctgtgggtggcaatggtcggcagcaggccgaccctgatgggcaaggagggcttcccctcggccatcgccgttgcgggcatcgccagcaacgccacaaaaaccacggcaatgaatcgaaccagacccgggatcattttttccccctacccgagtgggcaaccatagcatggtcataagacccggcaaaccaattgcgcgagtattgtcatggccggcgagtcacccacccgccttctccgtccaggcccaggtacccagactcttgggataggcgggaatatttgccatgccgacataaactattaaaatctatggggtagtgtgtactatggaagcttcctcctccacaacttcgagggggaggaagaggccgatggggttccgacagcagcctccactcggatttgtagtgttatgacagttaagggcggacgaaagggtaagttttccaccaagcgcatggccatgatgccgcgctggggaaaagctcgccccggctccacccctcatggtcaccttgccctgttcgaacgcctgacattacgggcgcggcgccgtgccgacaggaccgggtccgcggcggtccatgaagcaactcccctgtccatcgctcccgtgcccgacctgccgccgtccctgatggccgaacgtgcggtcgtctggtcgaagggggcccttcgcgccgtgggttccgccgcatcggcccttgtccgccgggcgaccggcgcgctgttcacgcccttccgggggctggtggatggaatgcgctcggccttcgccccggtcacggccgagggtgaccgtgggcggggtgccgccgccttccacggtccgccgcaaagggccgccgcccccgccggcccggacctctccgatagcgatatccaggcagtcatcgcctcggcgctggccggcgtgcccgacaagggcgatccgactcatccggccgaccttgccgccttggccagcctgctgtcgtcgccgccgccgcgcaacgatttccaggcctcggatctggttcgggactgcttcgcctcccagggcgtggccgggctgcagagtcgagccctgttgggagttgcccttcatctgacccgggaattcggcctgccgacccggctgccgctggcctcggaccgggcctggcgcatgctcgatccggtcctgttcgaagacgaaatggcggcacaactggccggcatccgcgccttcatctctgattggcaaaagacccagcagaccttcctggtcctcgaattcgccgagatcgaactgatcgaatggctgttcgaatgcctgcatccggcccggcattccgacctgctgttcgaggtgatgaacttcaaagtcctgtccaaccgccgccagggtatcctgcgccgcattccccaccgggtccgcaagttcgtcaaggacgcgggcggcgggcacgaggccgtcctctacgccgccggagcccgcgcctacctggaccggctggtcaccacccacggcttcacccccatcgtcgagaccgccagcctctgcctggaggaagtggacaaggttctcgagaagctgaagccgccggccgccctgcccggccccggcggcgagggcgaagccctggcccgcatcaccccggtcaagatgccggcttccgagctggcggaccgggccatggcccccgccccgccagcggccgcccagcgcccggccgcggcgcctccgccgccgccggccatgcccgtggcacctgtggcgccacagcccttgtcgtcccagccgctgccgccgcgcccccagggcgccgcgcccgtcccggtggtgacctcgtctccggccgccgtcccgcaggccacgccccaggcgacgggcaatgtccgtcccgccaccatccgcctgctgcccaagcacatccgggccggcgccgagctgaccatcccgtcgcgctcggccggtcgcatcccctgggccgcatgttcaccaccggcggcacggatttggcgccggttccggctatttcggtcaagagcgcccaaacccgtccgggccggcggccggcgaccctgccggggccggtcaacgccgtcattccgcccagcctgccccatctggccctgcccgcccctacggccgcggcccagacggcgcccgcccagccccccgtggcgccggccgcgccccagccgaaggcggtcaccggccgggtgaatctggccattccgggccgtcccgcccccgccgcgccgtcccagcccgcgccgtcccagcccgcgccgtcccagcccgcacaggtccagccggcacaggtccaggccaggccggcgccggtcgcccctcctgcaatggcggttcctgtcgcagtcacgcctacggctccgatcgccgccgtgccggccgccctggccgagaacgccgccgcccagccccggggcgacaatgtcaccaagctgaccatggtgcagaagcggcgcctgcccatcacccaggccctcaagcgccaggcggtgatgcgggtgctgcgtggcgaggatgccgaggccatcgcccaatccatcggcatcagccggaccaagctggacgaatgggtggacaagttcgtggccgccggtgccggcgcgctgaacaccggccgcaagcgcaaatccgaagaactgaccgtggacaccctgcgcgccaagctggccgaggtcctggccaccgctcaattgatcgagcaggtgatggaatcctcgcttccccgccggcctttgctgctggcaccgccccaggaagccacgcccgaggtggcaccgccccggcggccgcgcaagaagcggggctgatcccctttttccgaatgacgccaccttgagtccaacgcctatgatgagggcgtcccattgcttgtcgggaggaaggccttgctgaaagccctgacccctctcctggccctggtcatggcctcgccagccctggcgcaggacgcagcaaccaccgccatcgtgatgttcgattccgtctgcctgacctgccacgagggagaatgcagcggccgcatggccctgcgcaccgagcgcggcagcgagggactggccgggcatgtggccggctatgtgggccggcaggacgaggtcatggtcagccgcctcaagggcctgatgagccagctcaagacggaatgccgcctgccgccgccgcccgtggcccttcccgccgacggcatctgggacggggccagtctggcaccgctcaccctggccgaccgccaaaggctgttcgtgcccctggggccgctgaatcccggcacccactcgacctccctgcgccaggacgaaccccagaggctgcgccttcaggtggtggccgacagcttcgacatcgttttcgaccaggacagcacggtcggcccgaccggcacccgcatccactggcaggtcgaagagccgggacaatattttctgcgcatcatcggacggcgccccgtcggcaccttgcgcataagcccttgagccatcctacccgctcgagacgccaagcgggtgtggacgaacgggcggcaatggaataagaattaggttcataatcaagaaaaggtggggggatcggggcgcggcagttggctgcggcgctatcctcgtgtgaaggtcaaccggtggaacggatgcgtatgacggcccagaagagcgacgaaagcgccctgcccctgatcgggatctacgagatcagcaagattctcggagccaccctggatctggacaaggccctgcacgacgtcctcaacgtgctggcctcctacctcaacatgcgccacggcgccgtggtgctgaaggacgaggcaggcaagccccatctggccgcggtcaccggcatgtcgctgcgcctggcccgcgaaggcgtgctgaaataccccttcgccgccgtggaaaaggtgatgaacaccggcattcccatggtggtgcccgacgccgccgaggaaccgctgctggtcgaatacatcgccgagaacgacgattccctcgaagacgagcggctgtcgttcttctgcgtgcccatcaagaccaccgacaagccgttcggcgcgctgtcggtggagcgctcgtggagcgacagcgcccagtacgtgttcgagcacgacctgcgcttcctcaccatggtcgccaccctgatcggccagaccgccagcctgcaccgcaagctggccaatgaccgcgaaaccctgatgaccgacgcggcccgcctgcacaagcgcatggccgaggtccgccccaccctgcccatccggggtctggaagacgtggtcggcacctctgaggccatggcccgggtcttcgcccaggtgcagcaggccgcccccaccaaggccaccatcctgctgcgcggcgaaagcggcaccggcaaggaactggtggcccgcgccatccacatcctgtcggcccgcgcccagaagcccttcatcaaggtcaattgcgcagccctgtcggaaagcgtgctggaatccgaattgttcggccatgaaaagggcgccttcaccggcgcggtggccgaccgcaagggccgcttcgagctgtcgtccggcggcaccttgttcctggacgagatcggcgagatctcctccaatttccaggccaagctgctgcgcgtgctgcaggagggcgagttcgagcgagtcggcggcaacaagaccgtcaaggtggatgtccgcctgatcgccgccaccaaccgcgacctggaagccggcgtcgccgacgggtccttccgcgccgacctgtattaccgcctcaacgtggtgccgctgttcctgccgccgctgcgcgaacgctcgggcgacattccgctgctggccatgtacttcctcaagcagttcaacgaggagaacggccggggcctggccttctcgcagaacgccctcgaggcgctgcagcgatgttattttcccggcaatgtgcgcgagttggagaactgcgtctatcgcaccgccaccatgaccaagggcgaggtcatcgacgagatggacctgtcgtgcaagcaggacacctgcctgtcgtcgaccctgtggcacaagcgcaaccccggcgacaaggcggcccccaccctcagcgcccccattccggtccccaccggccccatgatcccgccggccgccgccgctccggtggcgccgcctcagcccaggccggacatcccggccccatcggccgccgatcccaccccgcccgacgaagacctctccgagcgcgagcgcctggtccaggccatggaacgctgcggctgggtccaggccaaggccgcccgcctgctgggcctgacgccacggcagatcggctacgccctcaagaaacacaacatcgagattcaacagctgtgaccagctccggacttttgcccttccccctgaccatctgcggcatcgacgagttgcccgagcacgcggcggcgggggtcagccatgtggtgaccatcctcgacccccaatggccggaccccgagcacttcgccctttaccccccgcaccgccgcaccatctggcgcttccacgacatcgtcaacccgcaggaggggcagtcccatcccaccatgcgcgacgtggaagccattctggattacggcaccggactgaggacggaagtggtcgagcacctgctgatccactgccacatgggcatctcgcgctccacagccacggccatcatcctgatggcccagcacaatccggggcgcgaggccgaggccttcgcccatctgaaggcgatccgccccttctcgtggcccaattcgcgcatggtgcgcatggccgatgaccaactcaagcgcaagggcgccctggtgaccgccatgcgcctgcatcatcacggcgtcgcccgccgccatcccgacaagatgccctatctgcgggccagcgaacgcgccgccgaggtcccgcccgaggagtgaacccgtgtcgggctgtcgcccgaaccgatccggggcgatgccccggcccccctttatgtcttatgaagagaaggaagggaggtttggaggttcacctccaaccggggtccggggcgagagccccgcaagagcccgccgacctcactccgtcgcccggccatagcgccggcggcgatagcccttcaggctgcgctccaccgcgtcctcgtcgattcccgccgagcgcagcaccgcgccggccatctgcaggctggcctccaccgtctcgggaatgacggcggtggcgccgatatcgcccagaagctgttcctgggcgcggtcgcgggcccgggccacgatgggcagatggggcgccgcctgccggatgcacccgatggcgcgctcggcctggcgggcctcgttgacggtgatcaccgccgcccgcgcccggtcgatgcccaccgagcgcaggatgccggtgcggccggcatcgccgtaatagacgggaatgccgtcctcgcgcgccttggccacccggtccacatccatgtcgagggcgatgaaggaaatgccgtgctcggccagcagcctgccgatggcgcggcccacccggccatagccggcgatgatcacatggtcggccagatggcgcgccgtctcggggatcggttcgccgctggcttgcggcgccagtccctgggaccagcgccgccccagcgccgccagggcgggggtcagcaacatggacagggccacgctggccagcagggactggcccagcccgccgtcgagaagcttcagttcgagggcacggccgaacaccacgaacgcgaactcgccgccctgggccagcaggaaccccacccgcagtccgtcggccagccccaccttcatcagacggcacaggccgatcagcaccaccgccttgacagccaccgtgcccagggtcaggccaaggaccagcccaagccggtcggccaccaggggcaggttgatggacatgcccacggtcatgaagaacaggcccagcagcaggccgcgaaacggctcgatatcggcttccacctgatggcgatagcgggaatcggccagcagcagcccggccaggaaggcgcccagggccatggacatgccggcctcgccggtcacccaggccacggccaggaccaacagcaggttggcggcggtaaacacctcgggattgcgggcagtggcgatgaaccggtagacgggacgcagcaggaagcgcccgaccacgaagatggcggccatgaccagcgccaccttgcccccggccagggccagggcctcggccatgtgccgctcctgccccgccagcaggggcagcagcaccagcaccggcaccaccgccagatcctggaagatcagcacggccacggcgatgcggccgtgatggtccaccgcctcgccgcgctccaccaggatggccagcaccgtggcggtggaggagaacgccagggtcagcccgatgatcagggcggcactgctgcccaggccgagggcatggctgatgccgccgatggccagggcggtgaccaccacctgggccaggcccagccccaggatatagcggcgcatggtccgaagacgcgacagcggcaattccatgccgatggcgaacagcaggaacaccaccccgaattcggccagcggccgggtgacctccaggtcgaccaccgggccgggggtatagggacccagcgccacgcccgccgccagataggccagcaccgaggggatgccgaaccgctggaacagcggcaccagcaccaccgccgccagcagcagcgacaagacatcgaacagcgcttcggacccgtgcacgcgatcactccccattggtcccggggagtatagcggcaagaacgcccgtgtcgaaccgctgtcagacggtcttggcgtccaccaggaagccggtgaccgccgcccgcagcgactgggcccggtccgccagggaatgggccatgtgggccaggtctccggccatggcgcctcccgcctccacctggcgggacaccttcgagatgctgtcggtgaccgagcggccgccctgggccgcttcctgcacgttctgcacgatggcgtcggtgacgtgcccctgctccaccgccgccgaggccaccgctccggccacggattcaatgcggccgatggattcggccacccgatgattggtggcgaccacctgggcgaccgtgtcctgcatggcggcgacctgccggccgatctcgtcggtggcccgcgccgtctggttggcgagattcttgacctcgcccgccaccacggcaaagcccttgcccgcctcgccggcccgcgccgcctcgatggtggcgttcaacgccagcagattggtctgggcggcgatgtcgttgatcaggctgaccacctcgccgatgcgcttggccccgtcgtccagggaggccatggtggccccggccccctccatgacgtccacggtctcgcgcacgatggcggtggtctcgcggacgcgttcggcgatgcccatgctcgacgagcgcaattgcccggtggccgaggccacttcctgcacattggcgcaggattgggcggcggccaccgccaccgaggcgctttcatgcccggcatcgtccacgttgcggtgaagattatcggcggtggtggagacggtgcgcaccacctcgcccacgtcgcccagcagcgactggacggtgcgatcgaattcggcggtccgccgttccagatattccgcccgttcggcgcggcggcgctgctcggccagggcggccgcttccagttcgcgggtgcggcgcatggtgtcgcggaacacctgcagcgccctggcgatctcgccggcttcatcgccgcgttcggcatcggccaccggctcgtcgagatagcccgccgccatgcggtgggtggccgccgccacccggcccagcggtcccgacaccgaccggcggaccatgatcagggtgacgatcccgccgcccagcagcgcggtcagggcgcccaacagcaggccgatcttcagttggccggcgaaggcgtccatggccaggtggttttcgtcaacctcgcggtcggccatggcggaatactcgtccaccagcttgcccagcttctgccggttcgagcggttggcatcattgtcgccgaacacccgggccgccggtgccccctgttccaggccgagacggatcagttcgcggcgaaagcggatgaagtcgaccagttccttgttcagcttggcgaactcggcagtctgctccgcgggcaccacgccccgccactcagcggccattttctcgaaggcgtcgaggctcttggccatgggctcggcgaatttccgcacctcgtcggcgttgcgcgccatgtagacgccgcgcgaatccatgacgatggcgtagatggcgcttccggccttctgcccgaaggcggcccggcgcgacgcgtcgaggatggcatcggtccgggaatcatagctgctgatggcccactggcccagggcggcgatcaccaccgccaccacggccatgacgcccaccagaagctggatcttgaccccgatgcgcaaccgaccggccatggcttcctccatctcaatgcgcggcacacggtaaggcagctaccctgcttcgcgatacggccaagagtggcaatggaccgggcgggaagtcaacatattttacatacttttggtatatgaataatttgtaaaatccatttacgtcttacataaatcggcggggcggattatttcacaccaccccgccgtattttcatgccgcccggttcagcgcgctgaccaccgccttcagcgaggccatggtgatggaggaatccagggcggcgccgtggaccgagcctccgccctcgccggcgatttccacatagcaggcagcctgagcctccgagcccgagcccagggcgtgctcgtggtagtcccgcaccttgaccttgcggccgaggccggtttccagggcatggatgaaggcgtcaagcgggccgttaccccggccttcgatgcgcttttccacgcccttgtcgcggatggtggcgctcagcatccgcgtggcgccgcgtccttcggaatgggtctcgtaatccaccagttccagcggccagtccttgagataggtctgggaaaaggcggccatgatctcacccgaatccagctcgcggcccaccttgtctgccatggcctgcaccacccgggcgaagtcgatctgcagcggccgggggatctccagcccgtggtcgcgctccagcacggcggcgataccgcccttgcccgactggctgttgatgcggatcaccgcctcgtagctgcgccccacatcggccggatcgatgggaaggtacggaacctcccacaccgggtcgttggccttcttgcgggcggagaagcccttcttgatggcgtcctggtgcgagccggaaaaggcggtatagaccagttcgcccgcataggggtggcggggatggacgggcagccccgtgcattgttccgccgtgcgccgcaccgtgtcgatgtccgacaggtcaagggcgggatcgacgccctgggtatagaggttgagcgccagggtgaccacgtccacattgccggtgcgctcgccattgccgaacagggtgccctccacccggtcggcgccggccatcaccgccagttccgccgccgccacgccggtgccccggtcattatggggatggaccgaaacgatgagggagtcgcggttcttcacatgggcacagaaccattcgatgacgtcggcgtagatgttgggggtcgacatctccaccgtggccggcaggttgcagatcatcttgcgctcgggcgtggcgccccaggcctcggccaccttctcgacgatgtccatggcgaagtccggctcggtgccggtgaagctttcgggcgaatactggaacaccacctcgccttccggccgggcggcggacagctcgcgcaccagcctgaccccggacagggcgaggtcgatgcagccctggcggtcgatgccgaacacgatgcgccgctgcgcctcggaggtggagttgtacatgtggacgatcacccgcctggcaccggccagcgcctcgaaggtacggcggatcaactcgtcgcgcgactggaccagcacctggatggtgacgtcctcgggaatatgcccgccctcgatcagcaggcgcacgaagtcgaaatcggtctgcgacgcggcgggaaagcccacctcgatctccttgaagcccatgccgatcagggtctgccacagggccatcttgcgctccgagcccatgggatcgatcagcgcctgattgccgtcgcgcaaatcgacgctgcaccataccggcgggcgggtgatggtggcatcgggccagcggcgctgggcgaggcggatggcgggataggcgcggtacttggtgctggcggcaggcatcatggcctggtcctccttatggtctgactgctgatatggggagcgcgacccggtctttccggccgccgggcggccgcgaatgaccttagccccggcgaccgcaggttagtcgcagcagcagcagaccggcgaaagccggagcggaaaccaaggagaaggcggaggaggagaaagacattgcagcgaacccgacccgaaggctgaaaccacgaaaacccggaaccgaacttacgattccagggtggctagcagcagcaggacggcggtcatctttctcatggtggccagcctgcccgaaaaaggggagttccgtcaagacccaatacctcggccataaatgaacgtgtcccccaccctgggaatgcgctagtgtcgtcgccatatcccctagacttgggcctgatggaaagagcatgcccttcgataccccaaaggacccgcacgtgccggccgcgcccgaccgcggctggaaccggatcgcaaccaccatggtgctggtggcggcggcctggctggggctttccgcctggatcgtggccatctatggcgattaccgggaaacccagttgcgtggtcaggtctcggccctggcggccagtgcgtccggggccttggggaacgccctcagccagcgcctggcccaggtccgtggtctggccgccttcgtggcggtcaagccgggcgaaattgaaaaggacttcccgttcttcgcggccgcctactaccaacaggtgcccggcatccgcaatatctcggtggcgcccgattttgtggtgcggatggtctatcccacggatgccggcaatctgaaggtcatcgggaaccacctgctggaggacaaacggccgggctttgccgatgcggtcaaccgcgccattcagacccgggggctggcggtacacgaaccggtggagatgatccagggcggcctgggcctggcggctcggcacgcggtgttcgtcgacggccgtccctggggggcggtggggatgatcttcaacatctccaccttgctggactccagccggatcggcgcccaggacaagtatgcctggggcctgcgcaccgccgccggcaccctggtgggaggcgacccggggatctttgccatgcgccccgtcctggtccgcgtcgacctgccggaaggatattgggaattcgccatggcgccgaagaccggctgggcccaggcctcggcggaaggcgccgaggtcaaggccctgcaattcggcctgctgattcttggcatcggcctgctgagcctgacctgggcggcgctgcgccggcgggtcaccctggagcagttggtggaacggcgcacccgcgaattgtccaacgccaaccgggagctggagcgcttttccttcatcgtcgcccacgacctgcaagaacccctgcgttccatcctctcgttcagccaattggtcgagaggggcatggccgaccagttgacccccgagcaacggggatggctgtccagtctgggggccgccgcccggctgatgaaagccctgctgcacgacgtgcagatctatctgggcgagggcaatgcccccctgcccaaacgccagctcgaagccgacgaggcgctggccatcgcccggcgcaagctgaaacgggtcatcgaacaaagcggcgccaccatcgaagccgagaccctgcccgtcgtatgggccgatcaccaccggctgagcgaagtcttccgctccctgatcgccaatgccatcgaataccgcgcggatgatcgcgtgccggtcatcaaggtatccagccgtacggacggcgccttccagtatatcgaggtggccgacaacggaattggcattgaggagatctatttcgaacgtatattcggcgtgttccagcgcctgcatgcgcgttcatcccatcccggcacgggaatggggctggcaatcgccaagaagatggtggaacatctgggcggaaccattcgggtccgctccgtggtcggacagggaagcgtcttctccatcgtccttccgtccacgccggtgtgggccgcagatgcgccatgggagtgaacgtgaccgacgcgagcgatcagcaattcaaggtcatgctggtagaggatgaccccggcgacgcggggctggtcaaggccgccttcgccggcagccgcttcacctgtatcatcgagcatattcccgatggggtcgaagccatgaagcgcctgcgcgcgcttgccaaggaaggggcttcgtcccttcccgacctgatcctgctcgacctcaacatgccgcgcaaaagcgggcacgaggttctggcggagatgaaggccgatgcggatctcaaggaccttccggtggtggtgctgaccacctcggacgccgagcgcgacgtggccgccgcctatcacagcggcgcctcgggttttgtgaccaagccggtggatgtggatgccctgttcgaggccatccagggcattctggaatactggttcggactgatgcgcttgcccgccaaccggccgtagcaacggtgccggcgtcgtggcggcgggccgaagacctcccccgccccggcccgaaggcctacaaccccttttcgaagtcggcgggggcgcgcagataggccccgaacacgtcgggcagcttggcgcgcagatcggaatccggatcttcctggtccagcttccacagcttgatcttctcgcagaagatcttgatcagcttcttgttgccgggcacgccgaagatctcggtgaacttttcctcgcccagcttttccgtgccgatttccaggaagatcggaatctgcgagtaattgaggaagcgcacgatctggttgatggcctcgcccgacaggatgtgcaggtggctggccaactgctccaggtccttggcgttctggacctccatggcttccagacggtcgcaatcgacgcacatttcccagaatttctcgcccatcttgtcgtagacggtgccgtgcaggtagtcgtagcggtccttgcccaggaaagcgacgcccttggcggcgaggggctgggtatcgagcatttcgcgcatcatggcgtccgacaggatgcgcttggccgaatccatggagtggcggccgatatcggccagggcggcgatgccctccggcgtgcgcagcgtggtgacgcccaggcccatctcgcggatcagcttgaccggcagttcggcgaagcaggggatcagcggcacctgccagtcgtagtccaggtaatccttgatggcaccatagaactggtcggcctgggtgggtgacgacttggggacttccatgtcgccccacttgcccgacaccagggactggatcttctccagcagggtcttgggctccttcttgggagccaccggcgcggcgggcttgtcggcggtgccgaagcgcttttccgcataggccttggcgccggagcgcaccaccatggaaatcacctgattgagcgagcgctcgcagcgcagcatgccgtcatcggtggtgaccgggtcgccattccggtcgatcagcaggtcctggaactgctcgcgcttggtcttgaccagctgcatgcaggcgtaaagcaggtccggggtggccagcacggcggcatagggattgggaaacgccgccagcgcggggatcagctgggtgacccgggcggtcaccggccccttgatggtggcgatgatttccttgcggttggccgcgtccttgtcgagcggcttggccgcgggcttcgcgctgccggacatggtattccccttgtgaatggtcccgacgtcactcgccgagcatggtggccggcaattgattcatcttggacagcagatattccaggtcgtcgttctcgaattccacgcccaggtcaccgtactgggtgagaatgcgctcgatcatgcggcgcgagaagcgttcgcggtcgttgggcccgccgtcgtattccatttcgtaggacacgtcgatggcggcgcgcatggcggcgtagaacgccttgggcaggcccgccttctcgaacagggcctcgaagccgcgcttgccggcgtcatggatcagggtgcggcaattctccaccttgatcttggccagcttggcgatggccacctcgaagaaggtcatgtcgcccatgcacaccgagcgcagcatgatggacggcgtcagacggccgacattgtacaggtggcccaccagctgggccacgtcgctttcggaattggacaggcccagaaccgccagttcacgcgcctggatcatcatggcggcggcggcttcgggcgtcaggtcgggacgggccatcaggtgctggcgcaggttctccgagaccttggtcatcaggcgctcggccacggtgatgggcagaaccttccgctccaccatggacttgcccacctgctcggactcgccatagcggtcgaccacgcggttcagcgtgtcttcattcaggtcggcgccttcgttggacaccagggtggccacggcggtctcgttgccgctgtccaccagggcgtcggccagggtggccgagacatggtggcggccggcgacggcgacctgcttttccgggctctggctgcgaacgatctcgatcagatcctcgtcggtgaggacgtcggagaactgcagcatgggcagggacacgtcttccacgtcccgggccagcgacatggccacgtcgtggggaaccgtcgggttctccttgagctggcgggccagggcctcgcgcacgcggacctcggcatcgcggaccatgaggcggaagatgtcctcggccagcttgcgctcgccatcgctcaacccctggtgctgggaagcgatcttgtcggcgatctcagcccgcacgtccccggtcggattggagagcaggcgcttgacgtcttcttcgttgagcttctggtccacggctgtcttctctatgcccctttcggcggactatacatcgcttcatccgccctgaacaggcgggaacccgaggcgacgccggttacatcatatcagacaaaaacgcactcagcaccttcggggcgaccaattccagcccggcggcgtgacgggccgcgtcggcgcgcaatcgaggcaccgacaggcccggcaccgagccgatctcacaggcatggccgatataccagcgctccagccctgccccggtggcctccacatgaaattgcaggcccagagcggccttgccccaggaaaacgcctggttgcgggtgacggcggtggaggccagcagcgcggcgccctcgggcaggtcgaaggtgtcgccgtgccagtgcagcaccggaacgccgtccagggacgccaggggcgacgtcagccccgccccggtcagatccagggccgaccagccgatttccttgacgccgttgttggaatagacgcgggcgcccagggcgcgcgccatcagttgggctcccaggcagatgccgatggtgggacgcccggcccgcagccgcgcctcgatcagccgcagctcaggggccagaaaggggtagttgccgtcctcgtaggcgccgatggggccgcccaggaccaccagcaggtccgtggacgcctccgagagggcggccaggtcatcgaggcccgcctcggcatagcggatggcatagccggcggcctccagcggcgcctgaaagctgcccaggtcctcgaacgccacatggcgaatggcgacacaggtcttcatcatcccccgccggaaaccgcgatcggccctcccaggccccagccctcccaggccgaggccccttcatacccgagcgggcctccggcgtcgaggctgacttacggccgtggttcaggcggcccgcacgtccttaaggaatgcctcgatggtagaacgcaggtttcccgattgctcggccagggtgcgcgaggcctccaggacctcccgcgacgaggtgccggtctggtcggcggcgtcctggacctggaccacgttgcccgagacctcggcggtgccggccgccgcctgttccacgttgcgggcgatttcctgggtggcggcgctttgctcctccaccgaggcggccacgtcgccggaaatatggccgatctcctcgatgaccttgacgatggcgccgatggtgtcgaccacccgctgggtctgatcctggatggcggcgatctggcggccgatatcgtcggtggcccgcgccgtctggttggcgaggttcttgacctcgttggcgaccacggcgaagcccttgcccgcctcgccggcccgtgccgcctcgatggtggcattcagcgccagaaggttggtctgcgacgcgatgtcggtgatcaggctgaccacctcgccgatcttctgggcggtgtcggccagttcgttgaccacatcggcggctttggtggcctcgcccaccgcatcttgcgagatggccgaggaatgggccacctggcggccgatttcgttgatggagcccgacaattcctcggcggcggcggccacggtctggacgttgaccgaagcctcctcggacgcggcggccaccgaggtggcctgatggctggtctgttgggcggtggcgctcatggcgccggcggtggcctgcagctgaccggcggcggcggccacctgctgcaccatggcgctggcggcgttatcgaaggtggtggtcaggctggcgatgcgcaaggcccgctggcgggcggcctcgtcggcctgcttctgcttttcctccaactcgcgctggtgaatcaggttggcgcggaagacttccatggcggcggccatttcgccgacctcgtcggcggtgctggcggcgggaatcgccacagaggtgtcgcccttggacaggctgtccatggcgccggtcatggccaccagcggcggcacgatggacgcggcggtgcgcagcgcggtgaccagggcgatgagcagaccggcgatgagggcgcccaccgccacggtgatcatggtgttgaccagcccctcgacctcggtggcgtcggtctccagcatccgcttctggttgtcgatcattcccccggagcgcttgccgtccgccgccttttcgcccgagaacacggtcaccagccgggtgacgcggggcacggcctcggtcaccaggaccttgatcgcttcctcaccctggcccagcccctcggccttggcctgggcggccttgagttccagcagcagcgtccgggcatccttccaggcctgctggttggcggagttggtgaaacggagcgccagcttgtccatgtcggcgatcagaacgtcgagatcaccccaggcctcggcgcgctcggccttgaaggcatccttgccggtcagcagatagccgcgcagcgccgccagggaggcatacatgtgcccctcgatgccggcgctggtctgggccaccggcatgcgcaggccgatcatgcggtcagcggccttgttgacgcccagggcctcgaaaatgatggtgccggtcaccaccgcgatcagggtgcacaaaatgccgaagcccaaccacaaccgcttaccgatcctcatttccgtctcccccgtcagaaattccaggtccaacggcggccatgcccctccgacacacggaaatggccgccgttgaccttcatcaaggggaccttaccaaaaagtggaatgcgaaatccatatatatgagcttttacctacgctggttgcatcccgaattctttccctttgcatcccggccccggcaggcgacaatcggcggccatgagcacagaaaagacatcctggctgaagaccgtcatcgagcccttgcgccccgtgatgcgcgaactgctggccgcctcgctgttcatcaacctgatggcgctggccgttcctattttcgtgatgcaggtctacgaccgggtgatcggccataacggcaccgcgaccctgaagggcctggtgatcggcgtcggcgtgctgatggctttcgactggatcatccgcacctcgcgcgggcggatcatgcagacggcggcgctgcgcatcgacgtggaaatcggcaccaagctgttcgacaagatcatgcacctgccgctgcgcaccctggagagccgcccggcctcgttctggcagaccctgttccgcgacgtggattccatccgcaacacggtgtcgggctcgacggcggtgctgctcaccgacctgcccttcgtgctgatcttcctgggggtgatcttcatcatcggccgtcccctggccctggtgttcgtcgtgctgttcgtggccttcctggtgctggcctggcgctcaggcggcgccatgaaggaaagcaccggcaaggaaaagaatgtgcagcaggcccgcgacgggctggtggccgagatcatcgccggccgcgccacggtcaaggccgtggccctggaccgcgccatccgccccatctgggaggagaagcaggccggcgccatcgagcagtccatccagcgcggcgccgtcaacgatgaatacgtcaatctgggccagatgctgaccatgctgggcagcgtggcgctgaccacggtgggcgcggtgttcatcatggaccacgacctgaccatgggcgccctggtggcctgcaacatgctgtcgtcgcgactttacggccccatcaaccagctggtgggggcgtggaagagcttttcctcgttccgccagtccgtggaccgcctgggcgaggtcttcgccgagtccgaggagcgccgccacagcgccatcgagcgcgagcgccccagcggcctgatcaccctggaggacatttccttcgcctatgaccagaagtcgcaggcggcggcctccatcgaccggctggagatccatcccggcggcatcaccgccgtgctgggccgcaatggctcgggcaagaccacgctgctgaagatcatcctcggcctctatcatccggccaagggccgcgtattgctcgacggcgccgacatcgcccagttcacccgggcggaactggccggctggatgggctatgtgccgcaggaatgcgtgctgttcaacgcctcgatccgcgacaacatcgtctacggcgcgcccggcgccagcgacgaggacatcctggaagcggccaaggtggccggcgtgcaccagtacatcatcgacctgcccgacggctacggcacctcgatcggtgaggccgggtccaggctgtcggcgggccagcgccagcgcatcgccatcgcccgcgccctgctgggcaacccgccggtgctgctgctggacgagccctcggccagcctggaccgccaggccgaggaggacctgcgcaccaccctggccgaactaggcaagacccgcacggtgatcatcgtcacccattcgccggtgctgctgcccatctgccgcgacgtggtggtgctggacaagggctgtgtcgccgccgccggccccgccgccgagacgctgcaacgcctgttcggcgcaaggccgccccagcagcctccagcccaaccgccgcacccgcaatcggcgccgcagccggccccgcatgtggtgtcgcagccggcggcgcccctgggcggcggcgtgcgcatcggcgtgggaggcgtgtcgtgagccagccccccgccccgccgcccccgccccagtccctgggccagatcaccccggtccaggtcccggccgggcaggccattcccggcgccccgccgccacccgcccccgcgggcgcaggcccgcaaacaagccaactgggcgaaggcccgcaggcaaaccaagccggcgcaggcccgcagatgagccaagagcagatgatgcaggccatggccgccatgatgggcggcggcggcccgcccggcgcccagaagggaccgcctcccacggccatgcaatccatcgccggcggccttaagaccttctggaagaccctgtgctggctgatggccgcgccggaaaagcccgaggacgcacccaagggcctgctggcctggccgcgccgcctgctgaccggcacccgcgactggttcctgccgtcgctcaatcccatcgggccggcgccgctgcaggactaccacgcccccgaattcggctcgcggctgtactccctggccaattcctatccgctgcccacctggcgccccttggcccgggcggtgatgagcctgaccgccatcttcatcgtctgggccttcgtcgcccatctggacgaggtggccatcgccgagggcgagatcgtccccgagggcaaggtcaaggtcatccagcacctggagggcggcgtcgtccgcgagatcatggccaccgacggttccgaggtgaaggagggtgcgccgctgatcctgctggacctgccggtcagttcgctgaacaaggaggaactgcaggcccgcatggacggctatatcctgcagcgcgcccgcctggaggccgaactgcacgacaagccggtggtcttccccgaggaggaagccaagcgccagccgggactggtggaatccgagcgccgctcgttcgaggcccggcgccaggccctcaacgccaccctcaccgtgctgcgcgatcaggtgcggcagaaggggctggaggtccaggaatacgagaccaagtcccgctccatcgccaccagcctgcgcctgtcccaggagcggctggccatgtccaccgacctgatcaaatccggcctggcctccaagatggaccatgtccagattcaggcccaggtggaggatctgaagggacagctggactcggtgcgcgcctccatcccccgcgccgaggccgcccagcaggaagccaagggcagggtcagcgaggaactggcccgcttccagcgcaccgcccaaagcgagatgtccgaggccgagctgaacatcgcacggacccgcgagctgttcatccaggccaccgaccagcagcgccgcaccctgatcagcagccccatcgacggcatcgtcaagaacatgcggtccaacaccatcggcggcgtggtgcgccccggcgaccccatcatggagatcgtaccgctgcacgagcgccttcaggtggatgccaagctcaaccccatggaccgcggctatgtccagaccggccagcgggccacggtgaagatcagcgcctacgactacaccacctatggcgggctggacggcgacgtgatcctggtggcacccgacaccaccgtgccccagacccccaatgcccagccctattaccgggtggtggtgcagaccgaccgcgcctatatcggcgacgagaccgccaagcggctgatcagcgccggcatgcaggccacggtggaaatccacaccggcacccgctcgatcatggagtttctggtcaagccggtgatcaagctgcgccacgaggccttccgcgagcggtaataaatcgagccacccctgtcacgtttgccggggccggcgcgtcatcagggcgtatctctcgaaaaaggatcgccgtcatgaatacgcgcttcgacatcaccaccctggcgccccaggcctatcagggcctttacgccgtctcggacatcctggccgggtccagcctgggggccggcttcaagcatctgatcgatcttcgggtctcgcagctcaacaactgccacttctgccagaacctgcaccgcgaatggggcctgcgcgacggcgtcaccgaggaacagctgcaggcggtggcccagtggccgacctctccgctgttcaacgccggggaccgggctgccttcgcctgggccgaggcgctgacgcgccaggaggaggacaaggtccccgaattgctggccgaactgcgccgccaccatgccgagccctatatcgccgacctgaccatggtcatcgcggtgatcaacgcctggaaccgggtgggcatctcggcctatgcggtgggaccccatggctgagggccaaagccccgccttggtccacttcctggctcagcggccgcgtctgcggctgctggcctaccgcctgctgggcagcaccgccgatgccgaggacgtgcttcaggatgcctggctgaaatggagcagggggagtgacggcgtggaggagcccgccgccttcctcaccacccaggtgacccggctggccctggaccgactgcgcaaggaccagcgccgcgcccgcctgggcgcccaatggctgcccgacccttgggtcgagccgctggagccgggcgaggccgatttgtccacagggctgctgttgctgctggaacgcctgacgccggaccagcgggcggtgtatgtgctgcgcgaggccatggacctagacttcgccgacatcgccgccattctgggcaagagcgtcgccacctgccgccagatcatgagccgcgcccgcgccgcgctgaagggcgaggcccgcttcgactgggatgcggcccagaccggcaccctggtgcggcgcttcgccgccgcctgcgaccagcgcgactacggcgccctggtggccctgctgggcggcgaatcccggctaatcagcgatggcggcggcaaggtcaagtcggcccgcaatcccattcgaggtcccgaccgcatcgcccgcttcatcctgggggtgcgccgcaagttccagcccgccgacttcgcctttcgcatcgccgagatcaacggcctgcccgccctggtcggcgagacgaagggcgacgtccgctgggcactgaccttcggctgcatcgggggacgcatcggcggaatctacctgctggccgatcccgaccgcctgccggactactccaccatctcgtcgtcggcatagccctgggcgtagagcagggtgaccagatcgccgtggtcgacccgcacccgggcctcggcggccaccaccggcttggcgtggaaggcgacgcccagcccggcggcgcgcagcatgtccaggtcgttggcgccgtcacccaccgaaaccgccagctcgggcgtgatgcccaactccgccgacacggcgttcagggtggccagcttggcctcgcggcctatgatggtgtcgccgacctgaccggtcagtcgaccattctcgacaatcagctcattggcgatgtcgcggtggaagccgcaggcatcgcggaccttggaggtaaagaacttgaagccgcccgacaccagcacggcatgggcgccgtgcttgaccatggtccgcaccagcttgtgggcgcccggggtgaattcgatgcggtcccaggtcttttgcagacactcttccggcagatccttgagcaggccgacgcgctcgcgcagagccgcctcgaagccgatctcgccattcatggcgcgtgcggtgatgcgcgcgatgtgatccttcagcccggcgaagtcggccagttcgtccagggtctcgccgatgaccatggtggaatccatgtcggcgaccagcagcatcttgcgccgcccctcggccttctgggcgaccacgtccacgttccagccctccaggatgcgggccgccacctgatcggcctgacgcgggtccagctcggagaaatccaggtcgcaggcgtgttcggggctcagccagcgggcgtggcccacttcggcgcccagtgccctcagcgcgccgcgcacctcgaagaccagcgaggaatcgaggccctctccgccatgtccggcgatcagggtcagaacgttgatcatggcgcgtccttgaggagaggaggaaaaacggtcccgtttactgcaccgcaacacggcttggcaagcaggaagcccttggctgatgccttggcgagggataaaccagtgggcgacgtcattgcttcgggaggtccaaagtgtccgtgccgctgctccgccccttccccggcctgcgccccacccccgccaccgccgcccaggtggccgccccgccctatgacgtgctgtcgtcggacgaggcccgggaaatggcggcgggcaagccccattccttcctgcacgtctccaagcccgagatcgacctgccccccggcaccgacgtttacgcccccgccgtctacgccaaggcggcggagaccctgagggccatggtggcggcgggcgtactggtccgcgacgccaagccctgcttctacgtctaccgcctgcgcatgggcgaccacgtgcagaccggcatcgtcggcggcggctcggtggcggcctatgatgccaaccgcatccgcaagcacgagttcacccgccccgacaaggaggacgaccgcgtccgccagatcgattcctgcgacgcccagaccgggccggtgctgctggcccaccgcgacacccccgagatcgccgccgccatcaaggcggtgacggcgggcgccccgacctattcggtcaccgccgaggacggcatcgtccataccctgtgggtgatggataacgaggtgcagatcaaggcggtgacccgatccttcgacaccatgaaggcggtctacatcgccgacggccatcaccgctcggccgccgcctcgcgggtcgccatggtacggcgggaaaggaagtgctgcgcctccggcgaggaggcctatgaaagcttcctggtagtgaccttccccatccaggaaatgaagatcttcgactacaaccgggtggtcaaggacctgaacggcctgtcgcccgacgccttcctgcaggcgctggcggccgagttcaccgtggagccgtcgtcggaacaggcccgccccgcccaggcccgccagttcggcctttacctccagggccagtggtaccggctgggcctccgcaacgctccacccgccgatccggtggcccggctcgacgtcagcctgctgtccgaccggctgctggggccggtgctgggcgtcaccgacctgcgcaaggacaagcgcatcgacttcgtcgggggcaagcgcggcctggacgaactggagcgccgtgtgaattcgggcgaaatggccgccgccttcgccctgttccccacccagatggaggatctggtggccgtcgccgagtccaatcaggtgatgccgcccaaatccacctggttcgagcccaagctggccgacgggctggtcagctatcccttggactggcggtgatctgatttgtcattccgagccatgggcgaggaatctccgcatggcaggacggtggcaattctgaaaagccgggccagaacgagatccttcgcttgcgctcaggatgacagcctcgaagaggtgacgaagcgccgggaatgaccttatatagggaagccgtttttcctgttcagcgggttgccatgaccatgtcgttcaagtccctcgccgccgccctcgccctggtgattctcgtccccgccgcccaggcccagacccaggtggttcccggctcgcgtgagcaggtgaagctcaccttcgcgccggtggcccggcaggtggcgcccgccgtggtcaacatctacaccaagcgggtggtgagggcggccgcctcgccgctgttcgccgacccgttcttccgccgcttcttcggcgacgtgccgggcatgagccaggagagggtgcagcgctccctgggctcgggcgtgctgatcgccgccgacggcacggtggtgaccaaccaccacgtcatcaaggatgccgacgaggtcacggtggtgctgtccgaccgccgcgaattcgaggcccgcatcgtcggctccgacgaccgcaccgatctggcggtgctgaagatcgatggcggcagggagagcttccccaccctgacgctcggtgattccgacgccatcgaggtgggcgacgtggtcatggcggtgggcaatcccttcggcgtcggccagacggtgacccagggcatcgtctcggccctggcgcgcaccaatgtgggcgtctcggacgtgcaaagcttcatccagaccgatgccgccatcaatcccggcaattccggcggcgccctggtggacctgcagggccggctgatcggcatcaacaccgccatctattccaaggacggcggttccaacggcatcggcttcgccattcccaccgccctggtgcgccaggtggccgcctccatcgccaagggcggcaaggtggtgcggccgtggctgggcgcctcgggccaggcggtcaccgccgatctggcccaggccctgaagctgccgcgccccatcggcgtgctggtcaaccacatccatggcgagtcgcccgccgcccgtggcggattggccgacggcgacatcatcgtggcggtggaaggccgcgaagtggacgatcccgaaggcatgcgctttcgcctcgccaccctgcccatcggcgccgatgcccgcctgaccgtgctgcgcaacggggccgagcggaccattaccgtccggctggtggcgccgcccgaaaccccgccccgcgacaagaccgacatcgccggccgcaatcccttttccggcgccaccctggtcaacctcaaccctgccctggccgaggagatcggcatcaattccggcctgaccggcgtgatgatcttcgccatcaagcgcggctcggtggccaaccgcctggggctgcaacccggcgacatgctgatgaagatcaacgagcgcccggtgtccagcgtcgccgacgcccgccgcctgctggaagcggaacagccccgctgggccatcaccatcaagcgcaacggcgaggtcatgagtctggtgctgggcggatgacctcgctgttcgacaccccctcgggcgacaagccgctggccgagcgcctgcggcccgcgacgctggaagaggtggtggggcagtcccacctgctggccgccaccgcccccctgggccgcatgctggcggccggacgtctggcttcggtgatcctgtgggggccgccgggctgcggcaagaccaccatcgcccggctgctggccgaacgggtcggcctgtatttcgagcccctctcggcggtgttctccggcgtcgccgatctgcgcaaggtgttcgatgccgccgaaaagcgaaaacagaccggtcggtcgaccttgctgttcgtggacgagatccaccgcttcaaccgggcgcagcaggacggtttcctgccctatgtggagaacggcaccgtggtgctggtgggcgccaccaccgagaacccgtccttcgagctgaacggcgcgctgctgtcgcgctgtcaggtgctggtgctgcaccgcctggacgacggggcgctggaggatctgctgctcaaggccgaggcggatctgggccgcaccctgcccctggattccgacgcccgcgccgccatgcgcgccatggccgacggcgacggccgctatctgctcaatctggccgaggacctggccatgctgccgcccgagccggtgctggacgccgccgggctggcgagcgcggtgcagcgccgggcgccggcctacgacaaggaccgcgagggccattacaacctgatcagcgcgttgcacaaatccctgcgcggctcggacaccgacgcggcgctgtactggatggcccgtatgctggaagggggcgaggacccgctgttcatcgcccgccgcctgacccgcttcgccgtcgaggatatcgggctggccgacccccaagccgtcacccaggccattgccgcctgggacgtctacgagcgcctgggatcgcccgagggcgaactggccctggcgcaactggtgatctatctgggcaccgcgcccaaatccaacgccgcctacatggcctacaaggcggcgcgcaaggcggccaagggcaccggctccctggccccgcccatgcacatcctgaacgcaccgaccaagatgatgaaaaacctgggctattccgacggctacaaatacgaccacgacgacccggacgggttctcgggccagaactacttccccgacggcatggatcgcacccgcttctaccggccggtcgagcgcggcttcgaacgcgagatcaggaagcggctggaatactgggataagctgcgcatgaaaaaggggggctgaggccccccttctccatcttgtcctaagggaaagcggctagcattccatcggcttgttgcgggtcctgaggaactggaaaaactcgacgccttcacgcaggcgacgcttcatcatgtcccagtcgtggagcatctcccagacgatctcgccgatcttggatgggcggaaatagaaggccttgtagaactcggccacgcccttgaagatttcctcggacgacaggtcgggataggacagcgctgccacctgccagccgccgccgccggtttccttcatcaccagatccttgtcctgcttgaaccagccgttggcgatggcctgctcgtacagttcggtgccgggatagggcgccgccatggaaacctgcagggtgcggggattgacctccttggcgaaggccagggtctgcttgatggtctcgcgggtctcgcccggcagacccaggatgaaggtgccgtgcaccacgatgcccaattcgtggcagtcctgggagaagcgcttgatgatatcgatgcgcaggcccttcctgatgttgttcaggatttcctgcacgccggattcatagccaaccaccagaacgcgcaggccgttggccttcagcacttccagggtcttgcgcggaatgttggccttggcgttgcacgaccacggcacgcccagatggccgatgcccttggcgatttcctcgacccgctccagatcgtcggtgaaggtgtcgtcgtcgaagaagaactcgcgcacctcggggaacatctggcgggccagggtcacttcctcgatgacgctcttggcgctgcgggcgcggtagacgcggccgccgatggtctgcggccacaggcagaagctgcacttggacttgcagccgcgccccgtatagaacgccatgtagggatggcggatatagccgatgaagtaatcgtcgggattgaggtcgcggcgatagaccggaccgacgaagggcagcgcgtccatgtcgtggatcatggcgcggtccttggtgtggaccggcttgccgtcctcgccccggaaggtcaggccgtcgatctcggcgaagggcttgccctcggccacttcgacgatggtgtagtcgaactcgtgccgcgccacgaagtcgatggcgtccgacgccagcagcgagggctcgggcaccgtcgccacatgggcgccgaccatgccgatcatgatgttcggattggcggccttgaaggcctcggccaccttgcactcggaggcataggtggcggcgccggcatagatcaccagcagctcgtaatccttggccagcttcaggcagtcgtccagggtcttgcccgaggccggggcgtccaccagcttggagccgggaaccatggcggccggctgggccagccaggtgggataccagttggacttgatctcgcgcttcgcctggaaacgggcaccggccccgccgtcataaccttcgaacgagggcggattgaggaaaagcgacttcttcatgtctgactgccttcaacctgatcgagtgtgccgtcggcacggacggcgaatcgccggccacgccataccacagtccgtccgcaacatgcgacaacatagacgacgaacgacagaatttccctcatgcccagcagaccgagaccgcaccggggaagccccagcgcccgctcctcgacccgaaccgcccacaaccggcaaagcaccgccaacgccagcgccgccacggacggccaccacgcgccgcccgccagcaccgccagcgccgcaagagccaccggctgggtgatcaccgaagccatgtaggaagtccggtccaccgccgcaatggtccggccccagcgaatttcatgatcgagcaaagttttgagcgaaggctcgtggacgttcatgtccaccggccgcgccgccaggacgatctcgagcccctggtcgcgcaccatgcgccccagcacccaatcatcggccagcacctgggagagggccgcgaggccgccgcccttttccagcacctcgcggcgcacagccatggtggcgccgaaacaaccgtccttgcggccgatggcgcgggccagcaccgcgccgggcaaaaagccatggttgatgcccatggcgcccagggaactccacaggtcgggctcgggccgcccgacgtaaagacaggtgacgattcccaccttggggtcgtcaaagggcgcggccagatcgtccagataatggggtcccacccggatatcgctgtcggcgatggcgatcacgtcgtggcgcaccttgggccacatgttgaggaggttgcccaccttgagattgtggccgtggcgggcggaatcggccacccagtcgatttcggccccctccacgtcgccgggcagcgccttgaccacgtccagggctggatcggcggggtcggcgacgccgaataccaactgaaaccggggatagtcctggcgcaggcaggagtccagattggcggccatgccgtgctcggcgccgcacaggggcttcatcaccgaaatgggcggccgggcggcgggaaccggctccggtgcccgccggaagcgccggaccagcgcggccgaagccacctggaacaggcagcccgccaccgtcaatgcgatcaggaccaaacagaggccctgccagacgaacatcatggcgttacttgtccaatgccgcggtctgcttctccagggtctcgatcagcccgtccaggcccttggaccggaagatggacccgaattccgagcgccgcaccgccacctggctgaccgtgccttcgaacagcacgtcgatgatccgccactgcccctgatcctggcgcatcacgtagtcgatctgggtcggatcgccgttcttcggcaccagccaggacgagacgatcaccgagccgccggccgaggggcgctgctcgcccacctcgaaccgctcgccgttccattcgttgaactgggcggcataggtggccacggaaaagttggaataggcctgggccagcttgccggcctcgtcgggggacatcttggtggcggcagtgcccagggtggaacgggtcatggagggcatgtcataggcttcggccacggcggggcgcattttctcggcacggcccttgaagcccagcttggccccacccttcatggactcgagcaggcggtcgctgaacgtacggatgacggcctccggcccccccgcctgtgccgcagcgggctccgccagaccagaccacaaaaccagcgccagcatcgaaacggcaagaaacgaacgcatgcaaccctactccccagagtccgggaccttccgattggaacgcccgccggcccactgccataccatattgccccaaggggagccagagcgcaccccgtacgccagccggacttgaacgccccgactggacaggccacctggcatatggaattctatcctgaggcttagggataaaatatgatgggcctcgcaagcctgtggaccggtgtcaaggaacggttcaggcggaaaccggccagaccggccggggcgccccctgccgcgcccaagccccaggccaagcggccaagccagccccagaccggctttctcgacccggattcgttcgcccgcgccctgctggattcctcggccgacggcaagggcggcgaccatcgcctgcacgtcttttccctgaccgatttccgccaggcggtgggcagcaagtggggcaagctcagcggattgctggaagtggccggcgacgccatcatccgccgccatgtggacctgtccaaggacgtgatcacccggctggatgccgagatcgcctgcctgtccatgccggtggcgtcgcgccaggaaagccgggcgcgggtggcctccatcgccgccgacctctccacctacctgttcggcgacgcgctgatcgacggccgccgcccccaggtggtggccgccaacatggcggtgaaggacgcggtaaccggcgaaggcaccctggatcacgaggccatccgcaaggccgtcgcccaggccggagccgccctgcccgccctgtccgggctgtcggcaccccatcgcgccaccctggcggccatgctggctcccggccaggacggacgccccgacggccagcaggcggccaaaggcaccgcctacgcgatcagcggcggagacaagccctatcgcgtcgacgaatccaccgtgcccaaatgggtcatggaggagccgaggaagcgggccagcgaccagccgctgccggccttccgggtagagggcgcctcccacggcgacggcgacggtccttcccgcccgctgtccctggagagcggcggactccatggcgccgacgcgccgcgcaccaccctgaccgtggaaggccgtaccctgaacggggcggatgccccccgcgaagtcctgcgcatggaaggacccaccctggcgggcgccgacgccccgcgcgaggtgatgaatgtggcgggccggcagggcaagggcgccgactggctggaggagcagctggagcttcaggccgaagccggcctggcctcggatcaccacctgtcgccggaatccaacctgacgctggtatggactcccacctgggtggccaccaagcgggcggtgggcgccttccacgccaaggtcatccgcgtcgacaaggagggaaccccgccgctggaaggggcctacgcctacgccaacgccgcccccatcgaatcgctgaccatggaccgcttcgtcgccacccaggccgcccatgagctgaaggatctgttctacggtcggcacaagctggggctgaccgtaccgttccactggatgagtctggcgccgcgctggcgcgactgcatccgcatcccgttcgaaagctgcccgccccaggcgctgaggaaacatctgaaaatcgagatcttcggcctgacgccggccattccgccccacgtcatcgcccgcctgttccagccgctggaaaagctcgactgcaccctgatggcccgcctgcccctgtcggcgccgggcatgatcaaggccctgaagggcgtcaaggccatcggcatcgatctggcccagctggcgccggaggaaaagaccggcgacgccgaactgctggagcgcctggagcgcttccgtgacgtggcccacaagtcaggcatggcctgctatgtctggggcatccgccgccgcccgctgatcaccgacgtgatcaaggcgggcttctcgctggtcaacggaccgggcgtcatgaccgacctcgcccatccgaggccggcgtcggggggatagcccccctattccatgacgatgcgcggacccttgcggctgctttgcaggacctggaccttgtcccagatccgggcggcgatctccatatagaccttggcgtgggggctgttgggcttggagatgacgatgggctcgcccgcgtccgccgtctggcggatggagatgtccagcgggatctcgcccaggaagtcggccgacaggcgcgccgcttccgccttggcgccgccatggccgaagatgtgggcctcgtcgccacatttggggcagatgtaatagctcatgttctcgatgatgccgagcaccggcacatccaccttgcggaacatgttgaggcccttggtggcgtccagcagggcgatgtcctggggggtcgacacgatcaccgcgccggtcagcggcacccgctgggtcatggtcagctgggtatcgccagtgccgggcggcatgtcgatgatcatcacgtccagctcgccccaatggacgtcgcgcagaagctgctccagggcgcccatgaccatggggccgcgccagatgatcggcgagtcctcgggcaccaggaagcccatggacatgcacttcacgccgtaattctccatgggcatcatggtctggccgtcggggctgaccggctcgccggtgatgcccagcatgcgcggcatggaaggcccgaagatatcggcgtcgaacaggccgaccttgagtcccatgcgcgacagcgccatggcgatgttggtggccgtggtcgacttgcccacgccgcccttgcccgaggcgatggcgacgatggccttgacgttggggagcagcggcttttccgcctgatggccgtgaccgccctggggagcgcccttggggccgccctgggtgttgcgctcggcggtcagcaccgccgacaccgacagcacgcccggcagatcatgcaccgccttctcggccgccttgcgcaggggctcgagatggggaccgcgttgggggtccacctcgatggcgaaggccacgtggccgcccttcagcgtcagacccgacaccatgccgagaccgacgatgtcggccttgcggtcaggatcaatgatccggctcagcgcctcgatgatctgctgttcggtgacctcggccatgctgtcctcttcgctgtaaagacacagtaaattagttgggtatgtgccgccaaagcgcacaagcgtcttctcatatagggggcgccgcccggtttgcaaagccgatttcgggccattttcaatattgaaaacccgtaatgtgaacggccccgcgttgcgcgaggcggaatcctgccctatgttccgagggcgtcggtggtttttgcctacgcgaccgagacttcgacgaagggacgattcatggcttggaatcctcgtggcggcggtggcccctggggcggcggcggcggtaacggcggcggcccgtggggcaacggcggcggcaaccgtccgggtggcggcggcggtaacggcggcggctttggcggcggaccggatatcgaggacttcatccgcaagggccaggagcgcctgcgccgcgccatgccgggcggatccggcggcgccaacggcgcccggggcatcgtcgccctggcggcgctggccgtggtgatctgggccgcttccggcatctataaggtcagccccgacgagcagggcgtggtgatgcgcttcggcaagtgggtggataccaccgagccggggctgcactaccgcctgcccttccccatcgaggcggtgctgctgcccaaggtgaccaaggtcaaccagctgctgctgggctcgcgcatgggcggagacgtgcgcggcggcggacgggccaccgacgaaagccgcatgctgaccggcgacgagaacatcgtcgaggccgaagccgcggtgttctggcgcatcaaggacgccggcaagtatctgttcgcggtacgcgaccccgagctgaccgtcaaggtggccgccgaaagcgcgctgcgcgaggtcatcggccgcaatcccatccaggcggccctgtccgacaagcgcgaactgatcgccatccaggcccaggaagaactgcagcgcctgctcgacgcctatggcgccggcattcacgtccagcaggtccagttgcagaaggtcgatccgcccagcgcggtcatcgacgccttcaacgacgtgcagcgcgcccgcgccgaccaggagcgcgcccgcaacgaagccgaggcctaccgcaacgacatcatcccccgcgcccgcggcgaggccgagcgcctgacccaggaggcccaggcctaccgcgagcaggtggtggatctggcccagggcgacgccaagcgcttcctgtcgctgtacggctcgtacaagcaggccgaggacgtcaccatgcggcgcctgtacatcgaaaccatggaggacgtcctgaagggagccaccaaggtggtcatcgacccctccgccaagggcctggtgccctatctgccgctgcccgaactgaagaagcagggaggcgccaaatgaaccgctccctgatgctcttcgccgccgtggcggcggtcctgctgatgctgggctcgtcctcgctgttcatcgtcaatcaggccgagcaggccctggtgctgcgcttcggcgcccaccgcgccaccatcaaggagcccggcctgcacgtcaaagtccccttcatcgaggacgtggtgcgctacgacaaccgccttctcgccctcgatccgcccgacgagcagatcatcatgggcgaccagaagcgcatcgtggtcgacaccttcacccgctaccgcatcgccgacccgctgaagttctatcaggcggtgcgcaccgaggtgcaggcccgcgcccagatgacccagatcgtctcgtcggccatgcgccgggtgatgggtcaggtgatgctgccctcgctgctgtcggacgagcgcgccaagatcatggagcagattcagcacgaagtggccgagcggtccctgaaggaactgggcatccaggtggtggacgtgcggctgcgccgcgccgacctgccggaggagaccagccagtccatctacgaccgcatgaagtccgagcgcgaacgtcaggccaaggaagcccgcgcccagggctatgagtggagccagcagatccgcgcccgcgccgaccgcgaacgcaccgtgctgctggccgaggcccagcgcaacgcccagatcgaacgcggccagggcgatgccgaggccaaccgcatcttcgccgaagccttcggcaaggacccgcagttcttcgccctgtaccgctcgctgcaggcctaccgcaccgcgctgggtgacggcagcaccaccctggtcctgtcgccggacaacgaattcctgaaggcgttcggagccggtccgggccgccggggtcaatgaccgacctgatgaccgccctggcgctggtcctcgtcatcgagggcctcgcctgggcggccttccccgacgccatgaagcgcatgatggcccaggttctggtcatgccgcccgatctcctgcgcggagtcgggctgttcatggcgatcctgggccttggcgccgtctggctggtgcgctcggccatgatcgcgccatagttgacggctagagtcccggcggcttgtcaggccgcctgaccgagataatatccagatcgtcccaattttcgtggggcgaaagcccatccggaggatgttctccagtgttcatcgcaagacgtgacccttccctcgctgccctgcgccgcctgatcggcgccctggcggtcatcgccctgctggtccccggatcgtcccgcgccggcgccccgcccggcggcttcgccgatctggcggaacggctgctgccggccgtggtcaacatctcgaccacccagaccatgaagcccagccagggcggccccgagctgccgcaattcccgccgggctccccgctcgaagagttcttcaaggaattcatggagcgccagcagggcggcaagagccccgacgcgccgtcgcgcaaggccacctcgctgggctcgggcttcatcatcgatgcggccggctacatcgtcaccaacaaccacgtcatcgccgacgccgacgagatcagcgtcaagctgcatgacgacacggtgttccaggccaccctggtgggacgcgaccccaaggtcgacctggccctgctgaagatcgagcccggcaagaagccgctggtccccgtgcccttcggaaattccgacgacgcccgggtcggcgactgggtgctggccatcggcaaccccttcggcttcggcggcacggtcacggcgggcatcgtctcggcccgcgcccgcgacatcaacgccggcccctatgacgacttcctgcagaccgatgccgccatcaatcgcggcaattccggcggccccatgttcaacatgcggggcgaggtcatcggcatcaactcggcgatcatctcgccatcgggcggctccatcggcatcggcttcgccgttcccgcctcgctggccgtgccggtgctggacgaccttcggaagttcggcaaggtgcggcgcggctggctgggcatccgcatccagtcgctggacaccgacatggccgagaatatcggcctgcccgaccagaagggcgccctggtggccaaggtcgatcccaacggtcccggcgtcaaggccggcctaaaggacggcgacgtggtgctgaagttcgacggcaaggacatcaccgagatgcgccgcctgccccgctacgtggcctccacccccatcggcaagaaggtggaagtggtcatctggcgcgacggcaagcgccagaccatcaccgccagcgtcggcgagatgcccgaggacccggccgagcagcaggtcaagggcaagcccgagactcccaagccccaggccggcaaggacggtatcctgaccatccccggcgccgggctgaccgtctcgtcgcccaccccccagctgcgcgagcgcttcggcctggacgatgaggccaagggcatcgtcgtcaccgaggtcaagcccgacagccccgccgccgaaaagggcatgcgccctggcgacatgatcatcgaggccgaccacaagccggtccgctcgcccgccgatctgggcaagctgatcgaggagggccgccgggccggggccaagtcgctgctgcttcgggtcgagaacccccagcaactgcgctacatcgccctgcccctggccgagggtaagaagaagtaggccggacctccggccgacacggacaaggggcgggtcctgccaaggacccgccccttttgcttggaattgcgggtggcacggcatcttaaagcaccgagcgtcaaatatgagacagggtgtcatcctgagcgccgcgaaggatctttcagcctgaagcggctggcgtcctcgcgtgaaagacccttcgctgggctcagggtgacagcttgtttctgattttgcgcacgatggtctaagacacacaaatacctgtcatcccgacgcccaagggcggagggacctccgcctggcctaccgtttccgaatcggacccgctgttccaggtggagatcccgcgccatggctcgggatgacagattgagaatccgcgcccccctcccgcccggcaaaaaatgccgaaggcccgccggaggtgtctccggcgggccttcctgggaaaagcgtccgatcagaacgggaagatgatgtcgaagatctgctggccgtagcgcggctgggtcagatcgctgaccatgccgcggccgccgtaatagacgcgggcctcggcaatcttttccgagctgaccgagttggacgagctgatgtcctcgggccggatgatgccctgaatggacaattcgcgcatttcgtagttcacccggaactcctggcggccggaaatcaccagattgccgttgggcagcacctgggtgatcaccgccgccatgctcatggtgatgctttccgtccgggtggtattgccggaattggtcaccgccgaggtcgacgacaggtcggccaggctggccaggttgatgttgggcagcagcttggacaattgctgttcgaagcccatggccgagatgggcgagccggtggtacccgagccggccttttccgagccggtccgcgagttggtcaggccggtggtcagggtggcgctgtcggcgatggacaccgccacggtcaggatgtcgcccacgtccttggcgcgctgatccttgaagaaagcccgggcgccgggccgccacagggagttggcgttctgcggcggggccgagggctgcggcatgggcatgctgaccggctggtagcccgacttctgggtcggattctgaatgggcgaggtctgcgggccggagcccacttccgacatgcgggtcagcatgttgcaggccgacagctcggacatggcggcgaccagggccagggcccgcagggtcttgcggccgaacaggcgggaggcggagggggtggacatgatcgatctctcccgaatacggctcagttgttggccagggtgcgaagcccgccgggcatcaccgacacctggccggggccttcgattttggcgtcgacggtctgcttgctttgaacgttggtgacgcggatgacgtcgccgacgctgccgtcctcgatggcacggccctgggccgtcagcgtcatgaacttggagcgcagcatgatggtcaccgagctgttcttggccaccaccaccggcttttgcacctcgttggtgcgcaccggcacgccggcgcgcaactgatagcgcggctcctggccgaccagcatgcgggcgttggagatgatgtcgcggcggaccacttcctcgcgcacgtccacccactggatgtcgtcctcgcggatcacgtcgccacgccccatggcatgcgccaggacggggatgcgggccgaggcgtagacgctgcccatcaccttgaagcggacggaattgggcgcgccggctggagcctcgaccaccgcctggaagcggttcatgcgcggatcgtaggccaggtccttgaccgccacggtggggctggcggtggcgggaatgacgatgtgaagctgctggcggttgctgatctcgatggaggcgccggcgggggcaccctccatggacagggcttccttcagctcggtctcgatggcgcggatgtcgacgctctggccggcgcgctcgaccaccgagcgctcgaagggcgaggccgggcgccagtcgatgccgtaggactgggcgacggccatcagccagcgggtctccagggtgatccgcttgcccggcgccggcgcattggccagcggcgtgccggccttgtcgccaatgttctcccagatgtcgccaagggtgatggcgtcgccgttgagaaccacgctgggcttcagctggggcggcagttcggcggcgagggcaccgcccagggcggcggcgaaagccaggccggcgatggtggcgcgaaggcagaggcggcggatcatgatggcctcactacttcatctggttgatggtcgagagcatctcgtcggaggcctggatgaccttcgagttcatttcgtaggcgcgctgggcgccgatcaggttggtcacctcggccaccacgttgacgttggaggtctcgaggaagccctgcaggatggtgccgaagccgggcttgcccggggtctgcaccaccggctggcccgaggccggggtttccatgaacaggttgccgccgcgggcttccaggccggcgtcgttggcgaaggtggccagggtcagctgccccttgatctggctttgcacctggccgtcctgcttgacgatcacctggccggtggagtcgacggtgacgcccaccgcgtccgagggaatggtcacctgcgggatcacctgatagccctcgtgggtgacgatggtgccttccggcgacagctggaacgagccgtcacgggtataggcggtctcgcccgagggcagcttgatctggaagtagcccttgccctggatcgccatgtccagggtgttgtcggtgctctggacgctgccctgctcggtgatgcggtacaccgccgtggtcttgacgcccaggcccagctgcacgccggtcggcacgatggtgccggtatccgacgactgcgagccgacgcggcgcaggttctggtagagcaggtccgcgaattcaggccgccgccgggtgaaggcggtggtgttcatgttcgcgatgttgttcgagatgacttcgacgttggtctgctgggccagcatgccggtcgcggcgatgttcagggagcgcatggcgagagttccttactcgttgaaccggtcagttggtcttggtgaagcccagggcctggatggccttgagctggcggtcgtgctcggcgtccagcatcttctggacaccctgatattcgcgcagaatctgggtcatgcgggtcatctccagcaccggctggacattggattcctccatcatcccctgggcgacgtgggggctttgcaccacttcgggctcctgggtggtctcgtagagggagtcgccggccttgcgcatctgctggtcgttctcgaacttgaccaccttgaggcgggcgacgcggccgttctcggtggagacggtgccgtcggatgccacttccacccgggtctcgttgggggcgaagacgatgggctggtcccggtcgtccatcaccgcgtaaccctgggaattgaccagcatgccggtctggtccaggcggaaatggccgttgcgggcatagcgcatgccggcttcggtctcgatctggaagtagccgtcgccgtgcagggcgaaatccaggggattgtcggtcttggtcagcggaccttcgcgggtgtcgcgcagcacgcccacgtcctggacgaaggagagcttgccgccgacggcacgctcggacgagcgggtcggcaccagaaactcgcggaacatcatctcttcgcctttgaaggcgggggtgttggcattggccatgttgttggccacgacttccatctggcgccacagggccgcctggcgggagagagcgatgtaagatgtgttctgcatggtctcgatccgtgttggcaattgcttgcgccaccagtctcgcaaccggcgtgccaatttcagaaatcgagcatttccaccattttccccgtcaagcccccagttccgggaagggcttgccgggcagttattgccgggtgccccccggggttgctatcgtgcatccgcggcggggggaaagcgtgccgcgcaaatggggtggtttccctctcttttgcgccggcgcaaccttctgttaaccgcgaaggtctagtttttaagatgcgcacgtgtgggtcctggtgggccggcgcgtcgagcggcggaagagggtcatggccgaagatctggaagaagatttcgaagaaggcgaaggctcggaagagatctccgagtcaccgtcgaagaagctgccgatcaagaagatcctgatcatcgtgctgcccatcctcttgctggtgggcgccggagcgggggtctatttctccggcctgctggacaagctgacgggcaagaaggacgaccacggcgccaccgaggcggccgccccgcctccgcctcccaaggcggtgcaggcggcgtcgttcatggatctgcccgagatgctggtcaacctgcagaccaccggacgcaagcaggccttcctgaaactgcgcgtcgcgctggagctggaggcggtcaccgaccagccccgcgtcgagcagatgctgccccgcatcatcgacaacttccagatctacctgcgcgagcttcgggtcgaggacctgcagggcgcgtcgggcatgcatctgctgcgcgaggaattgctgacccgcgtcaatgcggcggtcaagccggtaaaggtcaatgacgtcctcttcaaggagatgctggtccagtgatgaaccggcgggatagaccgacatggcgatgaacgacgacggtggaaccacccgcggggccgatgacgaagaggccctgatgaaggagtgggctgccatggcgggcgacgacgccggcggcggcggcggcggcggcggcggtgacgccggcggcggcgacggcggggacatggccgccgagtgggaggccatgctaggcgccggcgacagcaccggcgagacccaggcggcggtagccaaggacgccacccgcgttctgaaccaggacgaaatcgactccctgctgggattcgacgacgacatgggcggggccaacgacaagtccggcatccaagccatcctgaattccgccctggtgtcctacgaacgccttcccatgctggaagtggtgttcgaccgcctggtccgcatgatgtccacctccatgcgcaacttcacgtccgacaacgtggaagtctcgctggacaacattctcagcttgcgcttcggcgactacctgaactccattcccctgcccgccatgctggcggtgttcaaggccgaggaatgggacaatttcggtctgctgaccgtcgattcctcgctgatctattccatcgtcgacgtgctgctgggcggccgtcgcggcacggcagccatgcgcatcgagggccgcccctacaccaccatcgaacgcaatctggtcgagcgcatggtccatgtggtgctgtccgatctgtcggcggccttcgaccccctgtcgccggtgaccttccgcttcgaccgcctggaaaccaatccgcgcttcgccaccatctcgcgccccagcaacgccgccatcgtcgccaagctgcgcatcgacatggaagaccgcggcgggcgcctcgaactgctgctgccctacgccactctcgaacccgtccgtgaactgctgctgcagatgttcatgggtgaaaagttcggccgcgactccatctgggaaacccacttggccgaggagctgtggctgaccgaggtggagctggaagcggtgctggacgagcaggtgatgaacctgcgcgaggtgctgaactggaagccaggctcgaaattcatgctgaacgccaccgccgattcgcagatcgacatgcgctgcggcgaggtggccatgttccgcggccgcatggggcgcaagggccagcacattgccattcaggtggatgaatccaccatcaagtccgggtgatcgccgtggattggaaagtcgtcctcgaccttatcgtttcggtgctgctgatcgccaccatcggctatgcctggatgctgaaccagcgcctgtcgtccttgcgcaagaaccgcgacgatctggccaagaccatcgccgccttcaacgaggcgacgctgcgcgccgaatcctccatccccaagctcaggaaggcggccgaggaatccggccagaccctgcaggagcgggtggagaaggcgcagtccctgcgcgacgacctggccttcatgatcgagcgcgccgacaccatggccaaccgcctggaaaacgccgtccgctcggctcgcaccgatggtcccaagccggcgcccgagccacgcggccccaccgccgagcgctcggcccagatcggcaccgcgtccacgcccaccatgccgccgccccgcatggccggcaaccgcgccgccgccatcgccgccgccgcggctgccgccgagtccgaaagcgacgaccgttccgaagccgagcgcgaattgctgcgcgcccttcagtccatgcggtaggaggcatcatggccaccaagacccgcaagcctgtccccggccccatcaaggtgcagcctcccggcgcgtccaagggctccagatccgccaagggcgccggcaagtccgagggcaaggctcccatcgtccgggtgctgcccgtcctgatcttcgtgggcgtgctgatgctgtcgctgcgcgtcggcgacatcttcaagggcatgttcgggctggaaaccgtctcggtggccgagctgcaggcgcagcagacccccaaggcccagcctccggccgcccccgccgccaccccggccgccgccaccgccccggcccagacggcccccgccgccccggccactgccggctccgacccgggcgccggcatgagccagacggaactggatgtgctgcagaagctgcaggaacggcgcggtaccctcgacgtccgggaaaaggacatcgaaaagcgcgaggccctgctgaaggccgccgaggaccagatcgaccgcaaggtcgcagagatgaagacgctgcagaacaccatcgaaggcctgctgcgtcagtacaacgaccaggaagacaataaaatgcgctccctggttaaaatctacgaaaatatgaagcccaaggaagcggcgaagattttcgagcagctggatatgaatatcctgctggaagtggtcgagcgcatgaaggaacaacgtgttgctccgatcatggctgaaatggacccgtccaaggccaaggcagttactgccgaattggcacaaagacgccagataccgatgccaagggcggcctcgggcgggtgattgtcgggggattgcataaaaaatgacttgcgcaagtgcggtcccccatcttaactaggaaaattcgtgggttaccggtttgttcggttgctggcggctagtgtctcgaaggagcggatggatggctgtcgataagaatatgaatgtcctcatcgttgatgattataagacgatgttgcgaatcatcagaaacctgctgaagcagctgggtttcaacaacgtcgatgaggcgaccgatggcgccatggcgctgcagatgcttcgcgtgggcaattacggtctggtcatttccgactggaacatggagcccatgaccggcctgcagttgctgcgtgaagtgcgcgccgacgccaagctgaagccggttcccttcatcatggtgacggccgagtccaagtcggaaaacgtcatcgcggccaaggaagccggcgtgtccaactacatcgtcaagcccttcaacgccgaaacgttgaagaccaagatgacgagcgtgttgggcgatttctaacgacctttggggggtctatctgtcatgtcggcgaaaggcgttgaccgcgatctagagcttcgcttggacgccattcgtgccgagcatggcgagaccattcaggtcgataaaatcggggaagtggttcgggccatgctcgaaaccatgacgggggatatcggtgccggggatttgcggctctatcgcgagttggaatccctggcccaatacatccatgccgccaaggaagagatcgccgcgcttcggcccggcgaaatcaccaatgagttcatcgcctcggcgaccgacgagcttgatgccatcgtcggcgccaccgaggcggcgaccaacgagatcatggatgcggcggagagcctcggctcgctgtcgcccatgctggaccaggacgtggccaaccggctcgacgagatcaccacgcggattttcgaggcctgcaccttccaggatatcaccggtcagcgtatcaccaaggtggtccgggcgctcaaggagatcgaggaccgggtggaaagcctggtcaagatgttcggcggcgacatgaaccatggatcaggtcagaaggaagacaagccgctgaccgatcaggatctcctcaacggcccgcagctccccggcaacgcgaccaatcaggccgaaatcgacgcgctgctggcaagtttcgactagccttccatgaaggctgccgagcaagccacaaccggacggccagagaaagcgcccgtgggcgcgaacgattcccgtcgtcggttgatcggcttgccgctcgccttcctgttgctgctgatcaccctgatcatgggccccgccgccggcgtggtggcccagacctcgccgcgtgccgccgagcatgacggcttcggccgtatggtgttcgactgggacgccccggtgaaattctcggcggagacggtcaacagccagctcatcgtccgcttcgatcggcccatttccggcgaccccaaggtggtgctaaagcccctggccaagtatctgaaaggggtgacgctcagccccgaccgcaagatggccaccttcccgctggccgtccccgtccaggtcaagagctttcagaccggcaccaattccgtggtggtcgacctgtcggaaaccaaggccaccacctcgtcctcggccccgccgccggccgagcaggcccttccgccggccgaggcccccgcccttcccccggccgaggcacccgcctctccgaccaagccaccggagacggccaaggccccggaaacggccaaggccaagcccccggagccggtgaaagctcccgaacccgccaagcccgccgagacgcccaagccacaaggccccgccaccgacctgatggtgcggggcggcgaacataccggcttcaaccggctggtgttcgactggcccaagccggtgggctattccgtggatgaggcgggcaataccgtctccatcaatttcgaccgcccggccaatgtcaacgccacctcgctgcgggcggcgctgccccccgacgtgggctttctcgaggccaaggccaacggcaagggcacctcggtgatcctgtcgttgcccaccggcatgcgggtgcgccatttcaccagcggcccgcgcatcgccgtggatctggtccgcccggcgggagccccgccgcccccgcgcgccaacggcgccgccgccccgcccctggcccccgctcccggcaccgaggagcagccgccggccctgaagcccctggaccagcagggcctgccgccggccgaggccaaggctccgcctcccggccccgcccccggcaacggcaagccgcccgccgccgccgcatccccggccgagggcgaggccgccgcccgcccgggcgacgacatccgccccgcccccaccggcaaggtggtcagcctgggcttcgccttcgacaagccggccggcgccgccgtgttccgccgcgccggctggctgtgggcggtcttcgacctcaaggccgagatggacaccaagctgttgaagcgcaccggcggcgacgtggtgatgcatgtggagcaggtccagggcttcaagggcaccgccgtgcgcatgatcacccggccgggcttcaatccgtcggtgcgcaaggagggccagctttgggtgctggacatccacgagcagcccatcgcccccaaggccggattcgacatcgccccccaactggatttccaagagcggggacgggtggtgatcaaggcctcggacggctcggctcccatgatgctgcgcgatccggaagtgggcgacatcattcaggtggtgagcgtccccgccatcggcgccggcgtgcggacggggcgcgaatatccgggggccgaattgctgcccaccgcccagggcatcgccatgattccccatgccgatacggtgcgcctggacaccaaccgcgaccaggtggaaatcacccagcccggcggcctgtatctatcgcccatgatcgccgccgagggtccgtcggggggcaaggtggccaccgacggcaatatgggcgccgacgtgatgtccaccgggccgctggacatctccaagtggctgcgcggcggcaacgacaagttcgtggacgaccaccgcaagctgatcagccgtctggcccatgtgcgccccgacgagaagaacgcccagcgcatggaaatcgcccggcattatctcgccaacggcttcggggccgaggccctgggcgagttgcgcgtcatggccgccgtggacccgctgatcgtcgacaccccgccttaccgggcggtgcgcggcgccgccagcttcctgatggggcgcgatgccgacgccatcatcgatttgtccacgccggcgctgaagggggacgccaaggttcagctgttcctggccgccgcccaggcccgctcgctgcccgaccccggcaagaatgccctggtgctgcgcctggcccccgaagacatcaagggctggccgcgcaatctgcgcatctccatcggcgagatcgccgccaggaccgtggccaaggccggcgattccaagggcgccgcccgcatcgtcgatgccatgatgggtcccggcctgtccaagcgcgacgtgggcaagctggcctatctctcgggcatggccgcccaggcgggcaagcaatgggacaccgccatctcgcgctaccgcgacgccgaggccagcgagagccgccccgaccgcgcctatgccgcccgcgatcgggtcgagttgatgctcaagctgaacaagatgagtccggccgaggccatccgcgacctggaaaagctgcgctttgcctggcgcggcgaggatttcgagttccagctgctgcggcgcctgggccaattgcagatcgccgccggccgctatggcgagggactgcgctccatgcactccctggtcaccaactatgccgaccaccccgagatcgggcaggtccaggaggaaatgagcgacaccttcaaccgcctgttcctggtgggcgaggccgacaagctttcccccgtggtggccatcggcctctacgacgagttccaggagctgaccccatcggggaccaagggtgacgagatgatccgccgcctggccgaccgtctggccggtgtcgaccttctcgagcgcgccggcgagttgctgcgccatcaggtggagttccgcctgtcgggcctggataaggcccgggtcggcacccgccttgccttcctgaacctgtcggaccgcaagcccggcctggcgctggaagcgctggaagccagcgaggcaccggaaatccccgtggatctggccgcccagcgccgctatatccgggtgcaggccctgaccgatctcggccgctcggccgaggcgctggccctgatcatcaacgaccagagcgaggacgccaaccggctgcgcggcgacatcaactggaagctgaagcgctggcccgaggccgccgccgccctggaatcaaccatccagaagcccatcggcaaccgcccgctggaccccgccaccgcccgccgcctgctcgacaccgccaccgccatgaccctggccaaggacgagcgcggcctgacccgcctgcggcgcaatttcggcccgctgatggccaagaccgagtggaaggagcccttcgacctgctgaccagcgagcccgagcgcggcatcatcgattaccgccgcctgggcgagaagatcaagcaggtccaggacttccagaccttcatgggcgagtggcagaagcgggtaaaggccaagggcctgtcgtccatcaactagaagcgaggatcatgaccatggccggacgcaattggatgggactcgccctgggggcgctgctgctggccggctgcacgtcgggcctgccgcccgccgcccagatcgaccccgcgccggtgcccggcgtcgccttgcccttcaacgcccgcgtcatgatcttcatgggcgacaaggacctgcagcgtaagctcaccatccagctcacccgctaccaatccgaggaaaccaaggtccaggacggccgcatcctggccgagaccgcccagaccctgctggccaagggcttccggctggtggagatcaacgaccccaccatccgtccccagatcgtcgtgcgcctcaccggccgccccggatggagcaagctggatggcgtgttcaagatcggctgcggcttcgacgtctggaccgccgacggccagccgctgggcaacttcgtcgcccgctgggattcgcccatgaaggtcgattacgccgtcgacctgccgccaagctatgcccagtgcctgaaaaagcccctggatgaattgctggcctcgcccgctttggcccgcctggccagccagggcttccgcgacccgcaccccaaggcggccgaggagtggatgcgggccttgggtccgatccccgcctggaaatagggaattccgcatgaccggggccgccgctcccctgccccgctcgggccgctttcccaaggcccaccgcccgttcttcctggccgccagcctctatgccgccctctccgtccccctgtgggtggcggaatgggccggctggctgcccggctgcggcacctgcgacccggtggcgcggcacgcccacgaaatgctgctgggcttcgccgccgcggtgctgggcggctacctgttcaccaaggtcacccgcccccggctgatcctggccctactggcctggggagcggcccgcatcgccgcctgggccggcttggggggcgaggcggggctggccctgtccctggcctaccccgtcctgctgttcgccttcggcggctggcccttcctcaaggccgccaagctgggacacaacatggtcttcgcccccgccatcgccgccttcgccgtcgccgaagccctgtatcaggccggacgcatgggaatgatcgagggcggcgagcgccggggcgccatgaccgccttctgcctggtggcgctgatgatcctggtcatgggcggacgggtgatccccgccggcatggccggactggtgcgcaaggaggaggctcgcgagttgttcgaccgcaaccggccctggctggaatggctgtgcgtgatcggcatggccgccgaggcgctgatccaggccctggggctgcccaccgtcggcgccatggccctggccggagccgccgggttgtggcgtcaggcccgttggcggccgatcctggccctttccgacctctcgctggggccgatccaggtgggccatgggctgctggccctggggctgatcgccgccgccgcctcggactggctgggcatcgggccgtccaccgacgccctgcatctggccaccatcggcggcatgggagtggtgaccgcggccatgatgctgcgcatcgacgccatccgcgagcgccgggtcggccagtggccccgcgccggcatcgccgccgccatcctgctggtctgttccgccgatctgcgtgcggcgggttccctggctcctcacctgttgattcccaccgccatggccctatggtcggcggcattcgctatcgtggcgtggagtctggccaggggttggagagaatgacgtcgacatcgacacccgccgtggtcatcgccggccccaccgcctcgggcaagtcgggccttgccgtcaggatcgcccgcgagttcggcggcgtggtgatcaacgccgattccatgcaggtcaccgatgccctgccgctgctgaccgcccgcccggcgcccggggacatggcgctggcgccgcaccggctttacgccgtgctgccgcccaccgaactgtgctcggcggcgcgctggcgcgacatggcggcaatggagatggcggcggcctggcaggcggggatgctgcccatcctgaccggcggcaccgggctgtacctcaaggcggtgatggaggggctgtcgcccattcccgagatccccgagtccatccgcgccgaggcccgcaccctgctggccgagatgggcaacgccgcctttcacaaccgtctggccaagcacgatccgctgatggccgagcgcctggattcgggcaactcccaacgtctggcgcgggcctgggaggtggtgacggccaccggccgttccctggccgagtggcaggacgagccgcgcgagggcgccgtcgaagcccgctggttcagcctggtcctcgaccccgagcgcccccgcctctacgcccagtgcgaatcccgcttccgcgccatggtgacggcgggagccctggacgaggtccgggatttcgaggccctgcgccttccccccgacctgcccatccaaaaggccctggggcggcgcgaactggccgcccatctggccggcgagacggacctggataccgccatcgccgccgcctgccaggccacccgcaactatgccaaacgccagggcacctggtttcgccatcagatgatggcgtccttgaccgcctcggagcaactttcggaaagtttaatagccacaatctttctgaaaattcgccaacacctcttgaccgccccgtaacatggggctaggttgtgcccccgcgccgcagtgcagcagcgcgcgcccctgcctttcttccagacggcagggtgacaacgacatgaaggataaggtgctgagatggtgcatcacgatacgttgaccggagcggaaatcctcctcaaggccttggtcgaccagggcgtagaggtcattttcgggtatcccggcggcgccgtactgcccatctatgacgagctgttcaagcagaaccgcctgcgccacgtgctggtccgtcacgaacaggccgccgtgcatgcggccgagggctatgcccgctccaccggcaaggtgggctgcgtgctggtgacttctggccccggcgccaccaacgcggtgaccggcctggccgacgcccagtgcgattcggtgccgctggtctgcctcaccggccaggtgcccacccacctgatcggcaacgacgccttccaggaagccgacatcaccggcatcacccggccgtgcaccaagcacaattatctggtcaaggacgtggccgatctggcgcgcaccgtgcacgaggccttccacgtggcccgctcgggccgccccggccccgtgctggtcgacctgcccaaggacgtggtccaggccaagggcgaataccagccgccgtccaagctgaagtccaagtacaagccccaggtgaagggcgacctcaaggccatcgagaaggccatcgagatgatcgcccatgccaagaagcccatcttctacgtggggggcggcgtggtgaattccggcccggcggcctgtcagctgctgacccagttcgtgcgcatgaccggctatccctgcacgctgaccctgatgggtctgggcgccttcccgggatcggacccgctgttcctgggcatgctgggcatgcacggcacggtcgaggccaacatggccatgcacgattgcgatctgatgatcaatatcggcgcccgtttcgacgaccgcgtcaccggcaagctggacggcttctcgccgaagtccaagaagatccacgtggacatcgaccccagctccatcaacaagaacgtggcggtcgacctgcccatcgtcggcgactgcgcccacgtgctggaagacatgatcaaggtgtggaaggccaagcagtcgcgcgtcgacgacaaggcgctgaaggcctggtgggccaagatcgaccagtggcggggcgccgattgcctgtcctttgagaactccaacaagatcatcaagccgcaatacgccatccagcgtctctacgagatgacccgtcaccgcaatccctacttctgcacagaggtgggccagcatcagatgtgggcggcccagcacctgaagttcgacctgccgctgcactggctgacctcgggcggcctgggcaccatgggctatggcctgccgtccgccatgggcgtgcagatggcccatccggaggcgctggtcatcaacatcgccggcgaggcctccatccagatgaacattcaggagatggccaccctggtgcagcatcgcctgccggtgaagatcgtcatcctcaacaaccagtatctcggcatggtccgccagtggcaggaactgatccacggcggccgctattccgaaagccacatgattcatcaccccgacttcgtcaagctggccgaggccttcggcgccgtcggcctgcgcgccgacaagccgggcgaggtggacggcgccatcaaggagatgatcgccgtggatcgcccggtgatcctggaactgcgcaccgatgcctcggaaaacgtgttccccatgatcatgcccggcatggcccataacgaaatggtgctggggccggaggataagggccgcgacaagccgggctcggaacaagacggcatggttctggtgtaaggggggaaggcaagtgaccatcgcgaagcaggaaatcaaccgccacaccatcgccgtcctggtggacaacgagtccggcgtgctggcccgcgtcgtcggcctgttctcgggccgcggctacaacatcgaaagcctgaccgtggccgaggtggatgccggcgaaaagctgtcgcgcatcaccatcgtgaccagcggcaccgccatgatcatcgagcagatcaagaaccagctgcgtcgcctggtgccggtctacaaggtgcacgacctgaccatcgaggggccgcacgtgtcgcgcgaactggccctggtcaaggtggccgccaccggcgacaagcgggtggaaagcttgcgcatcgccgacatcttccgggcgcgcgccatcgattccaccaacgaaagcttcgtcttcgaagtggtgggcgccaccgacaaggtggacgccttcatcaagctgatggagcccctgggactgacggatgtttcgcgcaccggcgtcgtcgccattgcacgcggaccgaatccgatttagaaagcccgccagaatttgcgcggacccgtctccgcctgtcgaaaggaacctctcatgcgcgtttattacgatcgggatgccgacgttaatctgatcaagggcaagaaggtcgtggtcgttggctacggctcccagggccatgcccacgccctgaacctgcgcgattccggcgtcaaggacgtggccgtggcgctgcgcgccggctccgccaccgccaagaaggccgaaggcgagggcctcaaggtcatgaccccggccgacgccgccaagtggggcgacgtggtgatgatcctcaccccggacgagctgcaggccgacctgtactacaacgacctggccgccaacatgaagcagggcgcgtccctggtgttcgcccacggcctgaacatccacttcaagctgatcgaagcccgcgccgacctggacgtgttcatggtcgcccccaagggccccggccacaccgtgcgcggcgaatacgtcaagggcggcggcgtgccttgcctggtggcggtggctcagaacgcctcgggcaacgcgctcgagatcgccctgtcctacgcgtcggccatcggcggcggccgttcgggcatcatcgagaccagcttccgcgaagagtgcgagaccgacctgttcggcgagcaggtcgtcctgtgcggcggcctgaccaagctgatccagtacggcttcgagaccctggtcgaggcgggctatgcccccgagatggcctatttcgagtgcctgcacgaggtgaagctgatcgtcgacctcatctatgagggcggcatcgccaacatgcgctactccatctccaacaccgcggaatacggcgattacgtcaccggcccgcgcatcatcaccgacgagaccaaggccgagatgaagcgcgtcctggaagacatccaggccggtcgcttcgtccgcgactggatgctggaatgcaaggccggtcagccgtccttcaaggccacccgccgcatccaggccgagcacggcatcgaagtcgtcggcgagaagctgcgcgccatgatgccctggatcgccaagaacaagctggtggacaaggccaagaactaaggcccgcccccaagcgttcgagaaggccccgacgggaaaccgccggggccttttttatggaagcaggatcgcccatgaccgcgttcaccggcttttcgccccaggcccccgccttcctcgccgaccttgccgccaacaacgagaccgcgtggttcaacgcccgcaaggacgactaccgcgacctgatccagacgccgctgcgccggctgttcgtggccgtggccccggccatgctggagatcgatccccgcttcgatgacaaccccatgggcggggcggtatcacgcatccgccgcgacacccgcttctcccgcgacaagtcgccctaccgcgtcaagcaatggatgagcttccgccgggccggcgaaggatggcaggaccgcccggccttcttcctggccttcggaccgggcggctatcgctatggcatgggattttacgccgccagccccgccaccatgaccgccatcagagcggccatcgccgcccgccccacccctttcgccgaggccatggcggcggcggaggacgccggtttcgtcctggagggcgaggcctatcgccgctcgcgcctgcccaaggggatggacggcagcctgcccgccccgctacagccctggttcggcctgaaaagcggccatctgcgccgggagcgccccatggagccactgttcttttcgcccgacctcgccgctgaactgacctcgcgtctggccaggctggccccgctctaccacctgctcagcgcgcaaagcgtccgaacagctcctccatgaaggcggcgaaggcggcgggggaggcttcggcgtccaggccggcggccttggcgcggctgatcagggccaggatcagcagcagttcccccttgcggccgaacatcttctcgtagacggcgggcggcagcagcagggccgatttggccagcatggcggtcatctgctcggggccgaggccgtaatccaccgccagacggcgcacggtacccgaaccggtcccggccagggcccgggcggcgcggcgcagttgctcgcgtcccggatggcccagggccgctttcaactccggcgtggtgagcagcggcaccaccgtttccatgcggattaggcgaccgtcattagacagaacctgactgaggcgcgagcggccgtcgccggtcagggcggcaccgggcagagcggcggcgccctcgacgggggcggcgaccgggagctcggcgaccggaagcaggtccatcggctccggcaagggctcgggggacagcgccaccggctcgaccacccattggctgggcatggcgcggccctcggcgccgccatccagccaggcggccagatcgccggcgtcacggaagtcgagaatgcgcgaccccagggcccgcacctcaggcggagtcatgcgggcgtattgcggaatgatcggcacctgccagtcatggagcaaatagcgccggatggcattgtacagcagatcgccggccgtcttgtccttgcggccacggccatcctccgaccgtccgttcatccaggcgagcatgcccgcccagcccacgccctcgggccggcgcagccgctcggcccgccccgggggaaagccgtccaggcgggcgcggaagtggcgtttggccgccgagcggacgatcatggcgatcacctgattgacggtgcggccacaggccaggggcgtgttgtcattgtccaccgggcgcccccgcccatccaccagcaggggccgaaaggtggcacggtgggtgcggaaggcgatgaagcagcggtgcagcagatcgcaatcgcgcagcgccgtctccagttcgcggccacgtggcacccaggcgagctcgggcaccagtttcgccagcttgtccatcaccggccccgccagggtccggttgagggcctgtcgcgtcctctgggcggcagaaggctgtatcgaggcggcacgcatcacatcaaggctccagacccatcgtggcaatcatccatcccgaaatcagcttagcgatttggtcgggtaaggactgtgagaggaaccacatatttttccactgtcgcgccagtggactggagggcttcctggaaccgatccgaaacgtttcaccggccctccccccctgcggccgcggccgaggggaccacccggcaaaatcatgaccatccgcacgattccgacacacgatggatgttgacatcgcaccgcgaaatggccttcctataggcgcggtgaaacgggtttcacgataatgtttcaccggccgcttccggcgggccgtgctcgcctcttttccgttccgcgcccgtccggcggcgcgccagagtgcaagagcgagtacatggatcacaaccgcgtcatcatcttcgacaccacgctgcgggacggcgagcaatcgcccggcgcctccatgaatctggaggaaaaggtccgcatcgcgctggtgctggaggagatgggcgtcgacgtaatcgaggcgggctttcccatcgcctccaacggcgatttcgaagccgtcgaggccgtggccaaggcggtgaagacgtcggtgatctgcggtctggcgcgggccaccaagggcgatatcgaacgctgcgccgaggccatcaggccggcggcgcggggccgcatccacaccttcttgtccaccagcccgctgcacatgaagtacaagctgcagatggagccggagaaggtgctagaaaaggtcgccgaatcggtggcctatgcccgcaagctgaccgacgacgtggaatggtcggccgaggacggctcgcgcaccgagcacgacttcctgtgccgctgcgtcgaggccgccatcgcggccggcgcgcgcaccatcaacatccccgacaccgtgggctatgccgtccccgacgaatacgccgccctgatcgccatgttgatcaaccgcgtccccaatatcgacaaggccgtcctgtcggtgcattgccacaacgacctggggctggccgtggccaattccctggccgccgtgggcaagggcgcccgccagatcgaatgcacggtcaacggcctgggcgagcgcgccggcaacgccgccatggaagagatcgtcatggcgctgcgcacgcgccccgacctgctgcccttcaagaccggcatcaagaccgagaacatcacccgggcctcgcggctggtctcgaccatcaccggcttcgtggtccagcccaacaaggccatcgtcggcaagaacgccttcgcccacgaatcgggcatccatcaggacggcgtcctcaagcacgcccagacctacgagatcatgaccccggaatccgtgggcctgcaccgctcgaacctggtgatgggcaagcattcgggccgcgccgccttcaaggccaagctgaaggagctgggctacgagttgggcgacaacgcgatcgaggatgccttcacccgcttcaaggatctggccgaccgcaagaaggacgtgttcgacgaggacatcgtcgccctggtggacgacgccgtggtgcgcggcaacgaccgggtcaagctggtgtcgctggaggtgctgtgcggcaccaagcaccagcccccctcggccaccctggaactgtcggtggatggcgaggtcaagggcgtgcgggccaccggcgacggtcccgtcgatgccaccttcaacgccatcaaggcgctgttcccccacgaggcgcggctgcagctctatcaggtgagcgcggtgacccaaggaaccgacgcccaggccgaagtcacggtccggctggaagaggacggcaagaccgtcaacggccagggcgccgaaaccgacaccctggtggcctcggcgcgggcctatgtcaacgcgttgaacaaacttctggttaagcggcaaaaaaccgcccccgacgccgccggggcgtgatatagcacgcgcgcggccggggtcactgtcaaagacgcatcgtaaggtgagcgagggattatgttttctaagctgacgggttggatgtccgccgatatggcgatcgatcttgggacggccaataccctggtctacgtcaagggccgcggtatcgtcctcaacgagccgtcggtggtcgccatcgccgaggaaaagggcaagaaaaaggttctggccgtgggcgacgaggccaagatgatgctgggccgcaccccgggctacatccaggccatccgcccccttcgcgacggcgtcatcgccgacttcgaagtggccgaggagatgatcaagcacttcatccgcaaggtgcataaccgccggtccttcgccagcccgctggtcatcgtctgcgtgccctccggctccaccgccgtcgagcgccgcgccattcaggaatcggcggaaagcgccggtgcccgccgcgtcttcctgatcgaggagcccatggcggccgccatcggcgccggcctgccggtcaccgagcccaccggctccatggtggtcgacatcggcggcggcaccaccgaggtggcggtgctctcgctgggcggcatcgtctattcgcgcagcgtgcgcgtcggcggcgacaagatggacgaggcgatcatcgcctatatccgccgcaaccataaccttctggtgggcgaaggctcggccgagcgcatcaagaaggaaatcggttccgcctgcccccctgaggacggcgagggccgcaccatggagatcaagggccgcgacctgatgaacggcgtgcccaaggaactgatcatctccgagcgccagatcgccgaatccctggccgagccggtgggtgccatcatcgaggcggtcaaggtcgccctggagcacaccgccccggaactggccgccgacatcgtcgacaagggcatcgtgctcaccggcggcggcgcgctgctgtccaatctggattacgtgctgcgccatgccaccggcctgccggtctccatcgccgatgatccgctgtcctgcgtggcgctgggcaccggccgcgccctggaagaaatgcccaagctgaagaacgtgctgaccagcatgtactagggcttgaggcataagaccaaaaccgtcagcccggaagcgtatgtcgccatccgggctgacgccgttttgggcctcgggaaatcttgggtttgacccgccttaattagtggttttaccatcactagatatagtagtatcgacccgacgctttcccgtcatgccggggatgcgcggcgcaacggaggggttcggtgaagcagtcgggtgcggcaggtcggctcgcgacgttaaggctgctggtccagcgcttcgcctttatgtcgctgatcgtcgcctcggtggcgctgatgatcctgggcaaggccgatatcgtgctgatcgagcgcacccgcgccctggtcgccgacgccctcgcccccatcttggacgccatggcgcggcccgcctccaccatcgcccagatcaccgagaacgtccacgagctggccaatctccggaccgagaacgcccgcctcaaggaagagaatctcaagctgatgcactggcagaccgtggcccggcgcctggaggccgagaacaccgtcctgcacgaccagctgaacttcattcccgatcccgaccccgccttcgtcaccgcccgggtgatcggcgacatgggctcggccttcggccagagcatgctgctgggcgccggcgccaaggatggcgtgcgcaagggccagaccgttctgaccggcgaggcgttggccggacacgtggccgaggtcggcgcccgttcgtcgcgcctgctgctgatcaccgacatcaacgcccgcaccccggtgatgctggaagccacccgcacccgggccatcctgaccggcgacaacagccagcgtccgcgcctgaactacattaccggcagcccggccatcgccgtgggcgaccgggtggtcaccgccgcgtcgggcggcgccttcccgccgggtattccggtgggcgtggtctcttcggtgaccgacggcatcatccgggtcgaacccttcgtccagcgccaccgcctggaattcgtctccgtcgtcgatttcggcctgggcggcatcctgcccttcgaacggccgccgccgccggagcgccgccgccgggggaaagaggagtgaagtcctccgtctgggtgaggatggacacctgggtccgccatctggtccccttcggcatcaccgtgttcctgctgctgctcaccgccattcccacccatattcccggcttttctggcatcgcgcccatgctgccgctgatgggggtctattactgggccatctatcgccccgacctgctgcccgcctggctggccttcgtcatcggcctgctctacgacatcgtcgccggcacgccgctgggggtgaacgccctggtcatgctgctggttcagggcaccgccgcctcccagcgcaagttcttcctgggcaagtccttcgccgtcacctggtgggccttcagcctgctgaccgccggggccatcggcatggcctggatgctgctgtccttcgtcaaggggcgcccgctggacgtcgccccggtggtgttcgaatacctgatgaccctggccctgttcccgctgctgacctggaccctggcccggacccagctcgccttcctgcgcgacgtctaggaaggaccggccatgtaccatgacaacgaccgctccaagctgttctcccgccgagccatgatgctggccggcggcaaggccggactgatgggggcgctggcggcccgcatgtactacctgcaggtcatggaggccgacaaatacgccgtccaggccgaggacaaccgcatcagcacccgcctgctggccccgccgcgcgggctaattctggaccgcaacggcatcgccatggcggtcaaccagcacaattaccgcgtcatggtggtgcccgagcagactccgtcgctggactacaccctggacgccctggccaagatcatcgccatcggcgacggcgaccgctcgcgcatccacaaggaagtgcgccgccgccgcagcttcgtgccgctcagcgtgcgcgagaacctgacctgggaggaagtggcgcgcgtcgaggtcaacgccgccgacctgcccggcgtggtcatcgacgtggggcaaagccgctattacccgctggagagcctgggcgcccatatcctgggctacgtctcggcggtgtccgagaacgagctgtccggcgacccgctggaggagttgccgggctttcgcatcggcaagggcggggtcgagcgcatctacgacatggccctgcgcggccgccacggcacctcgacgctggaggtcaattcggtgggccgcgtcatccgcgagctggagcgcaaggaaggcgagcccggtctcgacctcaacctgacgctcgacatgaagctgcaggaatacgccgcccagcgcctgggtgaggaaagcgccgcggtggtggtcatggacatccataccggcgacgtggtggtcatggcgtcgacgcccagcttcgaccccaattccttcaatcgcggcctgtccaacgaggaatggaaggatttgtccaccaatccccgctcgccgctgaccaacaaggccatcggcggcacctttgcccccggctccaccttcaagatgctgaccgcgctggccgccctggaggcccgcgacatcacgccggagatgcgggtgttctgctcgggccacacccagttgggctccctcaagttccattgctggaaaaaggaaggccacggcgcccaggacctggtgaccggcatcaaaaattcctgcgacgtctatttctatgaaatcgcgcggcgggtgggttacgaaaagatcgccgaaatggcaaagaagttcggcctgggcgcccccaccggcatcgacctgccgggcgagaagtcgggcatcatccccaacaaggcctggaagaaggccaccctgaagcagccctggtatcccggcgagaccctggtcaacgccatcggccagggctatgtcaccgccaccgccatgcagttggccaccatgacggcgcgcatcgccaatggcggctacgcggtggtgccccatgtggcccgcgaccaaatctcggaaaagtcggcgaaaagccgcgccaccccgtcctggcccagcctggacgtgtcgcgccagtcgctggccctggtccgcaagggtatgttcgcggtatccaacgagccgggcggcaccgcttacaaggcccgcatcacccaggaaggcatgtggctgtcgggcaagaccggctcggcccaggtacggcgcatcaccctgcgcgagcgcgagaccggggtgaagaagaacgaccagctgccctggaaggagcgcgaccacgcactgttcgtggcctatgccccggaagagagcccgcgctattccatcgccgtcatcgtcgagcatggcggcggcggctcggcggtggccgcacccatcgcccgcgacatcatgatcgaagtgcaaaagcgcgacatggcccgggtcgccaccgatgccagcggcgagcccctgaatcccgacctgaggagattctgatgctccggccgctgccgcgcacgccgtcgcgcctaaaccggaccgagatgtccatgcgcgacaagatctggcagatcaactggtcgctgatcgccgtgctgaccgccatcgccggagtgggcttcgccacgctgtactcggcggcccagggctcgatcgaaccctgggcgttcaagcagatgatccgcttcgccatcggcatcggcctgatgatctcggtggccatgatcgacctgcgcttctggatgcgccatgcctacaccttctacgccatcgccttcgtgctgctggtgctggtggaactgaaaggcaccatcggcatgggggcgcagcgctggatcgacctgggcttcatccagctgcagccctcggagatcatgaagatcgccctgattctgtcgctcgcccgctattttcacggcgccggccagcaggagatcggccgaccgctgttcctgattccgccgctgatcatggtgttcacccccgccatcctggtgctgaagcagcccgatctcggcaccgccatgatgctggtgatgagttccggcgccctgttcttcatggccggagtacgcatgtggaaattcgtggtggtcatcgccggggccggtgccgccgtgccggtggcctggcagttcctgcgcgaataccagaagaagcgcgtgctgatcttcatgaatcccgaggacgatcccctgggcgccggctatcacatcacccagtccaagatcgccctgggctcggggggcgtgttcggcaagggctatatgatggggacgcaaagccgcctcaacttcctgccggaaaagcagaccgacttcatcttcaccatgttcgccgaggaatggggcatgatgggcgggctggtgctgctggggctctacgccctgctgctggcctatggctacgccatcgccatccgctgccgctcgcagttcggccggctggtggcccacggcatcgccaccaccttcttcctctatttcttcatcaacaccgccatggtgatgggactggtgccggtggtcggcgtgccgctgccgctgatctcctatggcggcaccgccatgctgtcgctgctggtgggctggggcctggtgatgagcgcctatatccaccgcgacatccccatctcgcggcgcggcatgggcgaggactagagttcttcgcacttaaaaagtcgaagaactcttaagcccgagtggcacttgagccctgaaaaagcggagctttttcgtacaggcggcatcttaaagcgctggggcaatccgcctgcggagaagccacgcttcgggggcttttgcccccgatcccccaaccgggaagcacagcttcccggacctttcagcgtttcaaaagcgggaggttcagaggctgtgcctccgagcgggtctgggcggcagccctgccgcaaagcggggtttttgactctggtccaaagaaaaagccccgaggcggcgccttggggctttgggggctggcggatcagacgtccttttcggggtcgatgtcgaaacggcgcttgccgtacttgccggtaaaggacgggccgtcgtcgatctcgacgtgatcccggccgaaggtcgcctggcgcaacagccgctcctgcaactccatcagatgcttgaaatactgcatcatctggttggtggagttcatccagccttccagcatggcctgctgcatcgcaagcatgttcttgtagggatccgtcattgtcttgccctccagatgggcgggacatagcccaggcgggcgacggcgccgccccccggggtattcccgttctccccgcccctgccggatcttatccatgacgaaccggttgggaccagagaactcatggtagcgcagaagaggaacgcattccagccaccccgatgcaattccgatatggccggatcacagggcggcgagagcggcggtccggtcggcgtagatggacaggatcttggcgaagcccgagacgtcgaacacctcgcggatatggggcttcatggagcacagggcgaatttgcgggtgccccgcgtcatcttggcgcccaccagaaccacgcgcaggccggcgctggagatgtagtccagttccccgaaatcgatcagaatcttcggcgcgccggcgttgaccactgccaggacccgggcctcgaaggccttggccgtcgaactgtccacccgggccagggggaccagcacggtggcatcgccagcctgctcttcacggatttccataaccaaaaactctcctatgccgaaatcgtcttgcgcagcgtggtggtgttgcgccccccctcgtgcgcgtaatcggttccatccatgaattccttcaccagaaacacccccagcccgccgatggggcggtcatccacgtccaggtcgagatcggggatcggagcctcaacgaagggattgtactccttggcatcgtcgatgatggtggtcacgaattcgcggccatcgtagacgaactccacctggatttcatgactatcctcgtcatcatatccatatgagataatattggtgatcaattcgtccagacagacgttgaggttgaacgccagcttctccgggagattgtgtttctccacgaagacatcgaccaattcggcgagacgctccagttcccccacatcattggcgatgaccatggcgacccggtcgggttccatggggacggagacggacggcgtggcggcgggctgccgcaccggcggcgccgcgatttcgtcctcgggcgccccctgggccctgccgtccatctcgttgcctcccgtcgccggaaagccggtcagcatcagccgcggccggtcttccatgggcgcatccgcctcattggaagccagatcgaaccgcaaggtcaacatggtgatatcgtcgaattgtggcgcggatccaacgaaggcctcgaccgagcgcagcacggcggcgatcaccgcctcgggggcggtgtcggcagtgcggcccagttcggcgatcagccgcggctcgtcatagagggcgtcgacggaatcctgggcctcggtcacgccgtcggtatagagatggaccacctcgcccggcgccagctggaagtggccggtctcgtagtccagatcctccatgacgcccaacgccacgcccgacacgtcgcggatggcgtccacccggccatcgccgcgcaggatcatgggcggcggatggccggcattgcaaaagcccacctcgccggtgcgggtgtcgagcacgccgtagaagcaggtggcgaacagggtctgggggttgtcgcgggccagcatggtattgacgaaggccaggcattcgccgggggaactggacagcggcgccaccgccttgaccagcgagcgggtgatggcgatgaacatggccgccggcacgcccttgcccgaggcgtcgccgatgacgaagcccagattgtggtgatcgatgaagaagaagtcgtagaagtcgcctcccacctccttggcgggcaccatggaggcatggatctggaactcggcccggtcggggaagggcgggaagacctggggcagcgaggacagctgcagctcgcgggcgaagtccagttcctggcgaagcgccgccagctggtcgcgggtgcgcagggcctcgcgcaggatctccacgtcacgggtgcgctcggcgatcagcgattccagacgctcgtgctgttcgcggatgcgcgacgacatggtctggaaggccaccgccaacacttccagctcgcccttggcgccgtcgccgccctggtcgcccgaggtcgagcggttggacaattcctcgatctgcttcagatcacccagcaccgcctcgcgggcgtcctgctccagcatctcggacaggcgcagcatctgcagccggatgaacagttcctggcggcggcgctggcgctcgcgccgctcctccagcatgtcgatcttgatggcgttctcgcggaacacgcccacggtgctggcgatgcggccgatctcgtcgttttcgtgccgcacgtccagcatcaccgaggtgtcgccccgcgacagggcgttcagcacggcgatggcctggtcgagagggtcgaacgagcggcgcagatagaccgagaacaccaccagcaccagcagcaggaacacccccaccgcaccgatggcgatcatgcggatttcgtgctggcgggcctgggtgtcggtggaatcgcgcacgctgaccagggcgccgatcaccctgccctcgccgtcggacagcggaaacaccaccacggaatagaagcgcgagccgtcgcgccaggtctccagccggctcttgcgtaccgagatcttggactcgaagacccgccacagcaggtcgttggtgccgtcggtcatatggccggcgcgatccaccaggaagacgtccgagccggtggacgccttgaactcctccagcggcggacgcaggtcggagacgatggtggccacgccgatcaccgccttgtccagcgccgccagaggcacggtgatggcggcgatgaactgcttgtcgctgttctgggtgacgccggtgcgcgccttgcccgtctcggcgatcagacgcacggtgccggcatccaccagcggagtctccagcagcgatccctgggacgaatacagcaggtcgccgtccaggccgacgatctccacccggcccacgccgcgccgggtcaggccggcgatggtcggcgtcatagcctcgcgcgcctcgctggggctcttgcgggcgatggcggaaatcatctcctgattggccaacagcagcggcgtggccccctccaggcgctggacggtgttctccaccagcttgtcccagaagatctgctggccgttcaaggtggcctggacatagcgctcgtcggccagatcctcgttcttcacccccgcgaagaacagccccgccaccagcagggaataggtcgcggtgacgatgagggttacgcgggtgcggagcagcatgggtccccccgcccgttgttcaccgcccgggccaccgcgctgggcatggccatgtccggcggcaggaaacccgacaggatttcgagatattcgttgggctcgaacaacttcagacccttggcccggaaatcggcgaagggctcggctccgggcagcgagacgtattgccgctggctgaaatcctgcaccgcatactggggctcgcgcccctggcgcaatccatccagcatggcgaggaacaggtccaggcccggccggtaggtgttgaccacatgccagagcagcgagcggctacgatccacgggcagatagccgatcccgacaatgggaccggtatcgatgcccttgtccacccggtggagggtgcagccgatggcgtcggagccgtccagcatgcagcggaacggcgcaaacaggccggcatagcgcggcagggcgccgggatggatgttataggtccccaggggggggatatcgtaggtgttgggcttgaagatcagcgagaagcgcgccgaaatggtcaggtcgggagcaaaggcccgaatgcgggcctcaccgtccgggccattgagatcggtgatgctctcgatggtgatgccatagcgggccgacagggcggcaaaggtctcaagacgagccctcggcgcctcgccacgccccacctcggcgcgatcgagcagcgggaacaagatgtccaccggcagatcgcgttcgtagaacttgatctccgccagttcggggacggtgttctctacgggccgggtcttctcgctcatcagcaccatcaccttgcaatcggcaaggcgcggcaacagcgtattgagaatcaaggcgcccgccagatccatcttagtacagacaaggatacgcaatggcggccggtgaggattcaaggcttgctctccttcgcctcggtcccgtcgatgatctcggccagccccatcagcttcatgggggggaagagaccgatctgacgcaccaccggcatgttgatcagcaccgacaatcgcttgggcgcatcgatgggaatgtccttgggcgcaatcttgcgcaccagaatctgttccgccttgtaggcggtcagttgaccgaccgtgtaatagcggtagacgccgccgaacatggccttggaggtcaccaccggattctccgccgcggcgaaggtggggatggcatggtccagcgccgcctgggtcaggagatcgcggttgacgttgagaaaggtatcgggcgggatgtaaaggaaatccacccgagccgccttgatctcggccactttggccgcgatgctcgaggccttgggcttgccgccctccacctccaccggcaaggcgacgacgctgaagccggtggccttgccgataccttccaattgctccgccgccacctgggaattgcgctccaaggggttgtagaccatccccagccgctgcagcggccggtaggactggatcaggttgacctgggtctccatgggaaccagatagagcgtgccggtgatgttgcgttccgacgaggtcaggctgggaaccacgccgcccaccggctgcgacaccacggcgaacaccgccgggatatcggtgatatgctgcgccggatcgacggcatcgagacgccccagcatctcctcgctgaccgtggtgccccaggtgaagaccagatccaccttcagcgccttggcctcggcgacgaactccttcagcttggccttgtcctggccggcatcgcgaatgatcagttccaccgggatgccctggttggcgaagtaatccttgaagccctgggcagcatcttcccagccccgccacagggccatgtagatgcggaagggcttggccgcctcggccgccggggcggcgcccggccagaccaaggagcaaaggaccaggcaaagggctgcgaggcgcctcattcgtcccactccgcctcgatatgggggccggcatggtaggcgaaggacaggacggcgaacaccgccgccatggccagcaccacccagcccagcgccacgatcgccccctgatgaccgtagagaggaatcagcaccgccgccagcagcggaccggcaaagctgccgatgcgttccgccagacgcaggaaggccagcacattagtctggccgatggcgcggcactcggtccagcacaggtccggaatcatggccagttgcggcgaggccgacaggccgtgcgagatgcccagcatcaggatggctacctgtaccgcgatcaccggctcgccccagaaggcgggcaacaccagaccggccccgccgatcagcccccccaccgccagcagcccggcccgccagcccacgcggtcggcaaagcgggccgccagcggggacagcagaaccaccgataccggataggccatcatcatcctggccatgtcgccgagatcgatggccggatactggctgagggtgagcggcaccagaaaaaacaaaaatccggtcagcgcgatcttggccggaatggcggcaaagaccaccagtgccgaaaagcgccagttgcgcaacagccgcaggaagtcgcgcttgcggggcgacgccccctcggccaccggctgggcgctgtccagcaggcgccagatcaggatggctgtcaccaccgtcagcaccgccgccacgatgaaggtaacgcgaaagcccaccctttccgccagcacgccgccgatgccggtgccgcagacgctggcggtcagcacggcgcccacataaacgcccagcccctgggcgcgggtctgctgccgcgacacctgggcgatatagccctggcaggccatggtgatgaaggcatatcccagcgccgtcgccacccgccacacgatcaggtcatagacggaaaacgccagacccgacatgacgaaaccgatggtagcgggcaccaggccaatcaggaacacccggcgcgcccccagccggttggccagcagcgacgccgagggcgacgccagggcaattaccagcatgaacagggcgatgggcagccccatcaccagttccggcgtcaacccggaaatgggggcatagaggtcgcggatgtaaagcggcatgaacgagcgcgaaatctcttccgcgaacacgaacaggaacagcggcagacgaatgtcggtggcctggtgctcgttgacgatttcggtctggccgttgcgggcgaagcggaacaggaagcgcacccgggattcgatatccttgaccttctcgaccacccccggatcgaaatgggcggccttgacctcgtccacataggcctcgagccgacggaaaagctgatcggccagccggatggcggagttgaagccgtggacgaagcgcccgacctcgtcgtccgaggtcaccccggccgatgcgctgaaatcgccgcgccggacccggtccatgacgattcccactacccgcatgggtcccgtgatgttgaaggtcaccacgaacagcaggatctccaccgccaccagaaacgccaccagggtgaccaccgccagatcgatgagaatctcctggacgcggccccggacataatcctgatccatgcccacatggacgtggccgattcgcgtgcccttgatgttcatgggctgcgccagatcgacaaaaccgcccagggtgaacttgcgcgaatgctccatgtcagccttgaaatcggctccgccatagaccgattgcagggcggaaggctcgaccccttccgcgaacagcaccttgccgccgcgatcggtgatggccagatagcgcaattccggattggccgccaggacgggggcgaagaattgccccactccctgaagctggtcgagcggaatgccatagcccacagcccgttccaccgattgttccaggtcgcggccgatggcctcggccttcttgtccatctcgggcgtcaggccgcgggtgaattctcccatggcctcgttggcgatccacgctaccggcggtaccaacaccagcgcgaccagcaccagcaggcggatgaacagcgggcgagtgcggtcaaggatcatggccaccccctcacatcagccggtcaagacggccgacctcgtcggtggcgtccttgacatggtcgacggtctcgcgagtcttggccacgaactcggcgaagcgctcctcgaaggaatcgccgccgccctcgggaatggcgtgaccgcccacggcgagcacctcgcccatggtccgttccatgctgcccagcttgcgtccgacgcctccgaacagaaggtaaagcccgaacaccgccaccgccgaagcggccaccagggccacggcgatgcttttcagcaactggctgagcagaccggacacgcccttttccacataagcgatggggtagcgcagcaccacgccgccttccaccttgcccagattattgaccagaggcaggccgacgatcagattgtcctcgtcctcgacgctgaaggattgcggcatgccgctgcggatggcctcggccaggaatccgagacccgcgtgccgatggcgccgcgatcggtgtcgaacagcacctcgccgcggtaatcatagacctccacggccaggatctgggcatcgcgcatcttctcgcgctcgatgacctcctgcacctgccgcagctggcgcaacgcaaaccccaggttgagattatcctcgaccttcttcttgatggtgaagaccacgaaggaatagcgggattgcacctgggcggaatagacgctttcgaacttgtaataggcgaagaaggcggtcaccaccagggtgaacagcagaatggaaacgagggccagcgacaccttgcgggccagcgaccagcgcaccggacgggccggcggcaggcaggcgccggtgccgcccgcggtactggattgccccaatatttccaagactcgtatccttcccaccgggggacggttgaaccgagccgccgaagcgactagaagcatgttccgtttataggatatttaccgatgcagtccaagggcgtggaggcccaaattcccaccaaatccgtgaaatcggcgtgcctcccccaatcatctggttcactgaacaaaagattccaatgacttcgcagcagcggcatacagtgaatacctcattcgatgctataccggtgacatatccggtaggaatcttcgactctggggttggcggactgactgtggccgccgccattcgtcgcgccatgcccgacgagcggttgctctacctgggggacgtggcgcgccagccctatgggacgaagtcaccccgcaccgtgacccgttacgcggtccaggcggctgaattcctggttgagaagggaatcaaggccttggtggtggcctgcaacaccgcttcggcggtggcgctggaggccattgccgagcgctttcccggcctgccggtcctgggcgtggttgaagccggcgcagacggagccgcccgagcctcggcccgggggcgcatcgtggtggccgccacggaagggacatgccgctccgaagcctatgagcgggccatcgcccggcgccgcgacggcgcgctggtgcgctgcgtgccctgcccgctgttcgtggccctggccgaggagggcctcaccgacggccccatcgtggacagcgtcgcccgccattacctcggctcgctgttcgacggaaccgaaccgggagactgcctggtgctgggctgcacccattttccattgctggcccccgccctgtcgcggctggcgggaccggaggtcaccctggtggattgcgccgaggcgacctcgtccatgctggttcgcctgctggagggacgcgaggcgcccaagggcagtggtggcggattgcacctgatctccaccgacgcgcccgaacgcttcgcccgcatggcgggcaagctgttccccgccctgggcgccgtcccggcggtggaactggccgatctttaaacttcaccgacctgtcacttgagccgcaaggcggcccggcctaggccttctcccgagatttgcgggagaatacgatgcgcatcgccctggtcaccgacgcctggacacctcaacgcaacggcgtggtccgggtgctcgccaccctggccgccaccttgggcgatctggggcatctgatccgagtgatcgaaccctcggccttcgtcaccatcccctgtccatcctatccggaaattcccctggccctgctgcccggccgcaaggtcgcccgcctgctggaggaattcggccccgatgccgtccacatcgccaccgaggggccgctgggctgggcggcgcgctcctggtgccagaagcaccgccggcccttcaccaccgcctatcacaccaagtttcccgaatacatcagcacccgcaccggaatgccggtgtcgtggccctacgccctgatgcggcgcttccacggtccggcggcggcggtgctgtgcccgtcgccgtcggtgcaccgcgaattgctccagaaggacttcgccaacgccctgccgtggtcccacggggtggacacccaggtgttccagcccggccccaaggattttctcgacctgccccgccccatcttcatgtatgtgggccgggtggcggtggagaagaacctgcccgccttcctcggcctcgacctgccgggctccaaggtggtggtgggcgacggaccggcccgggcggggttgatgaagcacttcgccgacacccatttccgcatcgtcaacggcgaccaggaattggcgcgggcctatcgcgccgccgatgtcttcgtctttccgtcccgcaccgacaccttcggcctggtgatgctggaagccctggcctcgggcgttcccgtggccgccttcccggtgaccggcccaagggacgtggtgggcgacgccaaggtgggagtgctggacgaggatctgcgggccgccgccctgcgcgccctgtccatcccgcccgaggattgccggcgccacgccagccgcttttcctgggccagggtggcggcggaattcctcagccacctgcgcccgttccacccgcaggcacgagccggttgatctttcgaccccggggaacgacactggcgccccttttcccgatccggatggccgccttgtcgcttcgctccgccgcttttgtcctcaccctctgcctcgtcgccccggccgccttcgcgggggccagctgcggcacgcccgaggagatcaaggcggctcagttgcgccagttccactaccagctgcaggtggcggcactgaattgccgcggcgacgatccctcgctgcccggcaagtggagcagctacatccatcaccatggcggcaccatgagcgtcaacgccaacgtcatgcgcggctatttcacccgcaccggcaagggcgtcgccggtttcgaccgctacaacacggtgctgaccaaccgggaatcggtgcgggtccacgagaccgagggctattgcgagatcaatgccccgctgttcgacaaggcgatcaaggccaatggcccgcaattggtcgccctggcgggggagacggtgggccggcccgccgacatcagcccctgcgccgaacccaaggccgaagccgagaagaagccgaaaaagagcgccaaaaaggccgagtgatctactcctcgtcctcggccttgcgccgcgccgtttcccagtcgcggggcagcaccatgtcggcggcccacaggccgcgccgggcggtcaccgcctgcttctgcgcctcggcataggggccgtccttggcggcgcgggccaaccccgcgctcaccagcagccgtccgagatcgccctcggccaccttgcagcgcccccagagctgacccgaggccacgtcgaggatctcgcaggccacgcccctggccaccagttcgcccatgcgtttcctggccgggcgggcgcagtcgaattcttccttggccgatttcgagccgcacagatccttgcgcccgggggcgagaacgcccgccagggccacatgcaggccgcgcacctgcagcgccccggcgtcatagccctccgccttgccccagacgcaggccccgccctcggcatcctcggcgcagcgcggcgcaggcgctgccattggcgcggcgggagcgggcgtggcggcggcgggaggcggccccgccgccagggcgggagccgacacggctagggcgatcagggcaacgatgattgtatgcattttcccaggatagcgcgcctattggctgacgtcgatcctgaagccggcgtgacaggcggtgcagcggtccagttgctcgatcaggcggcggttgagctgcgccgggctttcgcccttggccgccgcctcggccatctggtcgaagccgccgtgcaggcccatggccagacgcttgaagtccagcggcagcttcagcagcaggtcgggcgccttgtcgtgggcctcgcccatgcccatggaggtcgcgatcctgcccaccctggcggtatcgccctcggccagggcggcggtgatgtcgcgcaccgccaccagcaggccgcgcatctcggagaagaccatctcgcgctcggccccgctcatcaggacggcggtgcgcccgtccggagcccgggccgtccggccgtggacgaacaggacgcccagggcggcggccgagcccagccacaggatcagggcgatcaggcccagacggttcttcatctcaatcttcccccgaatatgtcatcccgagcgtaagcgagggatctcatcctggaacggtatttccgatacggtatcgacgctccaggcggagatccctcctcccgatggtcgtcgaacttaaggactctaggccgcccgggaaatgcgcacccgccagacctcggggccttcttccaggtattcccagccgaaggtcccggcccgctcggcgttgaagtgataatacagcggcttgggatcatggtcattgaccaggatgaaggcgccgcccaccgccagggattcgaaggttccgaagatctgcggatgacggtcgcggggctggatggtgcggacgtcgagttgcggttcggacatggctgtctgggctccttggaatgggggagccccgatacggcaggggggggggatggggagggagggtctgccgcaccggggcgcaggtaaatacataagtgcagcgctaagtcttttccttgagcctggtcaagcgatgttgccgccctgccggcaaagaccatgcctgaaaataaggtacttcccctccccactcggaccacccctggacagcccgtccccccgcgggttaaaaccgcccgttacgccgcccccctagccgacgatggatgccatgcagaccgccaacgagatccgccgcacgttcctcgacttcttcgagaagaacggtcacaccgtggtgaattccagcccgctggtgccgcgcaacgaccccacgctgatgttcaccaatgccggcatggtgcagttcaagaacgtcttcaccggcatcgagaagcgcgactatgtccgcgccgcctcgtcgcagaaatgcgtgcgcgccggcggcaagcacaacgatctcgacaatgtgggctatacggcgcgtcaccacaccttcttcgagatgctgggcaacttctcgttcggcgactacttcaaggacctggccatcgagcatgcctggaacctgatcaccaaggatttcggcatcgacaagagccgcctgctggtcaccgtctatcacgacgacgatcaggcggccgatgcctggaagaagatcgccggcctgcccgaatcccgcatcatccgcatccccacctcggacaatttctgggccatgggcgacaccggcccctgcggcccgtgctcggagatcttctacgaccacggcgagcacattttcggcggcccgcccggcagccccgaccaggacggcgaccgcttcatcgagatctggaacctggtgttcatgcagttcgagcaggtggacaaggaaacgcggattccgctgcccaagccctccatcgacaccggcatggggctggagcgtctggccgccctgctgcagggcaagcacgacaattacgacgtggacctgctgcgcgccctgatcgaggcctcggcggaggcctccaacaccgaccccgacggcccgcacaaggtcagccaccgcgtggtggccgatcatctgcgctcgtcgtccttcctgatcgccgacggcgtgctgccctccaacgaaggccgcggctatgtgctgcgccgcatcatgcgccgcgccatgcgccacgcccacctgatgggctgcaccgagccgctgctgcacaagctggtccccgccctgacccgccagatgggcgaggcctaccccgagctggtgcgcgccaacgccctgatcaccgagaccctgaagctggaggaaacccgcttcaaggtcaccctggacaagggcctgaagctgctggacgacgagatcacccgcatcggctcgggccagaaactggccggcgaagtggcgttcaagctgtacgacacctatggcttcccgctggacctcacccaggacgcgctgaaggccaagggcatcggcgtcgacaccgacggtttcgcctccgccatggagcgccagcgcgccgaggcccgcaaggcctgggccggctcgggcgacaccgccaccgagaccgtgtggttcgaactgcgcgaaaagctgggcgcctccgagttcctcggctatgacgccgagcaggccgagggcaagatcgtcgccctggtggaaaacggcaaggtggtcgaagccgtccatcccggccatcaggtggcggtgatcgccaaccagaccccgttctacggcgagtccggcggccagatgggcgataccggcgtcatcacgctgggcaccccgggaaccggcggcaaggccaccatcgccgtcaccgacacccagaagaagctgggtgacctgatcgtccatttcggcaccgtcgagggtgggccggtggcggtgggcgaggacgcccatttcgccgtggaatccacccgccgcgacgccacccgcggccaccactcggccacccacctgctgcatgccgcgctgcgcgatatcctgggcgatcacgtcacccagaagggcagccaggtcggccccgaccgcctgcgcttcgacttcgcccacaccaaggccctgtcggccgaggaaacccgcgccgtcgaggccgaggtcaaccgccgcatccgcctcaacgccgaggtggccaccaaggtgatgacccccgatgacgccatcaaggccggcgccatggccctgttcggcgagaagtacggcgaggaggtgcgcgtggtctccatgggcgacctctccaccgaactgtgcggcggcacccacgccaaccgcaccggcgatatcggcggcttcaagatcgtggcggaaagcgccgtggcctcgggcgtgcgccgcatcgaggcggtgaccggcccggccttcctggcctgggcccaggcgcaggaagacctgctggccaaggccgccgataccttgaaggcggcccccgccgatctgcccgcccgcatcgctgggctgatggacgaccgccgcaagctggaacgcgaactggctgaggtccggaagcagctggccaccggtggcggccagggcgccgccaccaagacggtcaacggcatcacctatgccggcaaggtgctgagcggcgtgcccgccaaggacctcaagggcatggccgacgagatcaagaagcagatcggttcgggaatcatcgccctggtctccgatgccgacggcaaggcctccatcgtggtctgcgtcaccgaggacctgacgtccaagcacagcgccgtggatctggtccgcatcggctcggaagccctgggcggcaagggcggcggcggccgtcccgacatggcccaggccggcggccccgacgccagcgcggctcaggctgcggtggacaggatcgagcaggccctgggcgggtaaaagcgcaggcgaaggattttcgaccatttcgggggcttttgcccccgatccgccaatcgggaggcacagccacccgagcccttcagtgctttaaaaagctggaggtccgggcgggtgcccggccgcgaagcgggggttttcagcagcccgccagcacggttgctttcgcctgacgcctcagtgctggcggctgtccagaaatgtccggacggagggattcaggtggcgcagttcgagctgtgcgcccacccggcaggcatgcagccgcaacatgcccagcagcgccagcaaagacgcgctcagggtttccagttcggcaaagtcgaaaatcaccaccgcatccggctgttcgatcaccgtctcgaacccgacttcgatccggtcgaaatccaggtcatccagttgaccgaccagacgaaagacggtcttggcatcctcgtgcaccacttcacaggccatggcggcatccccttgcctcgccctgcgccgggccccacggccacggccccccgacaggacaggtcaggacatcagatataatacctgaatatatggcacctatactttagggttgaacggcttgtaaacttcttgtgcccattccttaaacgcccccccaaccagccgggggagtgcccgggagcctgtccgtttcgtcggaaatggaggggcgtcgggggcttttgcccccggtcccccaatcgggaagcacagccgcccgagcccttcagggctttaagaaatctggaggttgggaggctgtgcctccgaacgggtccgggcggtagcccggccgcgaaacgggggtttcgcagcccgctaaagcgggatgccttaactatgcatcacgctttagctttgtgtgcttcgccctcgcgggagctttatgtgcttcaccctcgcgggcgggcgcctcagcgcccttggccgctcgctctaggccttgacgggcgccggagcggcgccaggggtctgctcgttgcgcttcaagacgccggcttccaccagcttgttgaccaggtcgcccatggtgttgagcgagtgcaggaagccgtccaccggcatggcgatgcgctggcgcacttccatcttgccctggcccgattcggtgggctccagcgacaccagttcgatgcgaaccacgccgctgacgaaatcgacccggccgacgccgtcggcgaaaatctcggaaaccatgggcaaagcccctccctttgttgaaccgccgggatggtgggccaagcctgcccccaggtcaatcgggcaaaggccgggtcagtcggtcaaggccctgatcatatggtcggtattgcgcagacgctcggccagttgccgcgccatcaggcgatggaaggcggcggccaccgacggggcttccgcctccatgcggatcaggttacgggcggtcaggcggtgaatgacgcaatcggcatcggccaccaccgaggccgagcgctcctcgttgagataaagccccatctcgcccaccacggtcccggcatgcatggtgcgcaaccggatcgaggtgccgttatcggtgatcagccgtaccgtcacctgccccgattccaggatgaacaggtcgtgggcggcgctgccctgctgcagcaccacggtcccggcgggaacgtccagggtctcgacgaaagacatcatgcgcgccacctgcagcggctcgcccaaatcctcggccagatcggccatgagggaacggggcttggagcgggcctccacctccagcctggccagcaggcggttctccgaccattccagcgcgtgatccaggtcgggcgccgagcgccaggtggcaccctcggcacccacgaagccggcgcgttccagcaccatgcccgcctcggcgttctgcccggcgaagaccagggacagcccccgtttctcggcgaactggcgcagcttcacgaagctcatggccgccgaggtatcgatgccggagacgcggcggaagtcgaacaccaccgcctcgaccatgtccggccccggatcgccgcagcgcccgatcacccgggtcagcagcttgttggcggtgccgaagaacatgaagccctgcaggctgtagatcaggatacggccgccatgggccttgagcagcgccacctcttcccgggggcggtccacgttggaggacacgtcggcggcggtcagctcgtgcttggccaccgccacgcgggaataattgaccacaaacagcaccacgcaggcgacgatgcccaccgccgcgccctgcaggtagccgaaggtcccgaccacggcgacgatcatcacgatgatggcgtaatcggcccccggcatgtggtggcggccgtccaccagccattcctccaggaagcccaggccgatgaacatcaacaggccgcccagcaccgccttgggaaacagggccaacggctcggtgccgatcaccagcatggccaggcagaccagcgccgagatcagccccaccagccgcgagcacacccccatcttcagcaccatggaggacaggcccagggtgtggaagccgatgatgccgccgcccgctcccgataccagattggcgatgccggcgatcttcagctcgcggttcagatccatgtcctggttggccgccacctcgatgccgctggaattgagcagcacgccgatggcgctgatcagaaggatggtcgacaccgacccggcctggtcggcgatcatcagccagtcggccgacagcgcccggatcaccgcgtcgggacgccagcccccggcggcgggaagatgtcccagcagataccccccctgctccagcccctccaggctctgccccagcagccgggcgaccagatggtagccgaggatgccgccggccagcagcaggggcagggtcgccacatgcttccagcgccgcatgccgacgatcagcaccagggcgaaggccagccccggcatccacttcaccgcctcggccacggcgaacaggtggggcacgccctccagggtgggggcatggccggtcatcaccttgatggcgcccttgaccagcagccagccggtgccggccagaaagccgccgatcaccggatagggaatgaagcggatgaacccgcccaggcggaaatagcccagcgcgaacagcaggccgccggtcagcgccgtggccagcatcagggcgctggccaccgtggcgaacacctgctcgggatcggtgccgggcggcgtctcggccacgatcagcgaggccatcagcgcgaggatgggagcgatcttgtcctggggaaaggcgatggtgccgggatacgagctgaacagcgccaccagcgcccccaccaccacggcggtgaacagggccatgccgatggcggtgcccacatgcccggccagttcgccggaaaagatcagcacggcgaaggacagggacaggattaccaccaccagtccggtgacggcgccggcgacaagggcggcgggcaactcttgcctgctgatcgtcatcaccacctccccgccaggaccattgggcttagcgcggcctcaatggccgcccatgtatccacgtgaatggtagtctgatccgcataggctgttaagcgatatcggagcgatatggaaaagtcgcaatcaggccttgggaaaagccacgaggaaggtgctgccgacgcccatttcggactcgacccagatgcgtccgccgtggtgctcggcgatcttgcggcagaccgccaggccgatgccggtgccctcgaactgctcgcgggcgaccaggcgctggaaaatgccgaacacccgcttcaggtcgtcgggaggaatgccgatgccgttgtccttgactcccacgacccattccgccccctgggcgcggcagagcacctcgatgcgcggctggcggccttcgggcatgtacttgatggcattggcgatcaggttctggaacaggcggaccagttcgccgccatcgccggaaatggtcggaagaccgtccggcaccaccacctcggagccgctctcggcgacggccacttcgagatagcggagggcattgctcactacctcgcccaggctgaccggctccatgggggcggtgatgcggccgatgcgcgaatattccagcagatcgacgatcatgcggtccaggcgccgggcgccgtcgatggcaaagccgaagaagtcgcgggcgtcctggtcgaagctggcggaaagcttcttttccaacagggcgagataggcgctgatcatgcgcaggggctggcgcaggtcgtgggaggccacataggcgaactgttccagttcctcgttggagcggcgcagttcctccaccagttcggccagcttggcggcggccttcttctgctcggtgatgtcgctcttgacggccaggtagttggtgatgactccttcgatgttctggatcggctgaatggtggcctgttcccagtaaagctctccgcttttgcgccggttgatcagctcgccttcccacttctcgccggccgacagcgcggcccacatgttctggaaggtttccggcggcgtggtgtcggacctgaggatgcgggggttgcggccaatcacctcgtccatggaatagccggtgatccgcaggaaactgctgttgacgtactggatctcggcgttgagatcggtaatgacgatggagacggggctctgctccaccgcgcggttcagcatgtgcatgcggtgggcgttctccaccgcggcggtgatgtcgctgccggtgccgcgatagccgatgaacacgccgtcatcgtcgaaccggggcaggccgttgaccttgatccaccgcgcccggccgttaccgtcttccagccagtacttgaagtcgcggaacggccgctgggcggtcagatcggcgatatgggcctgccactggtcggaatcgatctccatgcgctcgctgacgatgtcccacgaacgcttacccagcaggtcgtcggacatgatgttcatcaccgtctcgaaggacgacgagaagaaggtgaagcgctgttccgcgtcgctctcccagaaccagtcggcggcggcctcggaatattcgcgatagcgttccgagctttccttgaccacctcggagagcaggctgaggcggtcgcgctccttgcgcagcggcccaatctcggcccgcagggcttggagggcggccccttcggcccggccgcaccgcgccaccagcaccagggtcagcgccaccccgagaccagccaccgcccaggccggcgggcccggcggcagcatcagcagcgccgccagacccaccgtctgaacgacggcgatcagaatgagaattcgcctgcgctcgctcatgacagacgcgcgatgaacctggtcacggtgaacatccgatggattccgcccctctcttcggcgcgccccgcacccgccccggacttgccaacgaaaagcataatagccaacttgccaaggcatggcaccttggatgatatcaatgacacaatatgttcccgatccatccttatccgccgggagaggaccatgagaccgatcgtcatcgcagccttgctctgtctgcttgccgcctgcgtgccgccgccggatcagccggcctattacggccgcatgggccgcttcatggggttggtggccaattgcggctgttccggaatcgggcccgaccagatggtcgcccagtaccgaaaggccctgggcgacctgtattcgcccaaggacgtcgccgccatggagggttatgtcaagctgggcgccggcgaggcctggaccaacatgacccaggtctgcgccgaagtatgcgcccagcactgcatggtccaagccgtggtcgaacccctgggcgccggcagcactggcgtggccccctgcctggtcagcgagcgcgacctccacctgaccgacggaacccagatcaataccggggacccaggccccaattgacccgtaccgccgcaccacgaaattacggtatgttacggatgcttgcggtatcattcacggcctgttgacaagaagggtggattggcgacacacctatccattagtctagtctggacagtcggaccggcgtcacggggagcgggatgatgaatgcgttgggcagggggggcggctgattcgcttgcccagccgtaccgggggctggcgaaccgaccccgagatcggcgaggcggccagcaccacgggcggcggcctgcgcgtggtcaaggatacgctgcatgtcctgctggtggaagacgagcccggcgacgcccggctggtggaatacgcgctgcgcatgtccagcgcgccggtcttcgtggtccgccacgtcaccaccctggccgcggccatcgcccacatcaacggcggcgagacggtggacgtggtgctgctggatctcagcctgcccgattccaccggcatcgccaccgtatcgcgcatgcaggaggcggcgtcgcgcacccccatcgtcatcatgaccggcatggacgacccccgtttcgcctcctatgccctggaggccggcgcccaggattacctgatcaagagcgacgaccccgaacgtacggtggggcgcgccatccgctatgccatcacccgcatggcgggccaactggagcgccaggccctgctggaacgcatcgccgagcagcagcgtcatctggtcgaggaggtcaatgccgcccgggccatgcagttcgacctgctgccccggcccgagcgcctggacgagcggctggccaagctgggcatcgaggtcgagtcctttttcgagccctcatcgggcattggcggagacctgtggggctgcctggattgcggcggcccgcgcatgagcttttactgcttcgacttcaccggccacggcattggggcggcgctcaacgtctttcgcctgcacgccctgatctcggaccattgggacccgcgccgccagccgggcgagatgctgaccaccctcagcggagccctgaagagcctgctgggccgggggcaattcgccaccatgttcctgtgcaccatcgacgtcgaagccggcgagatcgaatgggcctcggccggcgctcccgccccggtgatcatgcagggcgaggagtaccgcttcctggacgccagcggcattccgctgggcctgtccaaatcccccagctaccgcgagcaccgcgaggcgttcccgccggatgcgtccctgttcatgtattccgacgccatcaccgattcgccgaccgagggcgacgccctgttcggcgaggcgggcctgggcagcgccatccagggattgctgcgcagccacggcgagttgcgggtggaaagtctgctcgatgaggtctgccgccaggttcagactccgttcgaagacgacctgaccgccgtctgcatcaagcggctgaaaggggagggctaagcatgtccttggtcaccacaccaccgctagccacctgccaggcgccggagcgccatccctgcctggtggtcgcgtccccggcgtccgaggatctggaggcccagtgccgggctctgggcgtcggactgcaccagggcgacgccgtttccgagattcctccggcatcgatcctgggcggcgacgccaccacggaaagcgtccgccgcggcttggccgcgccctattgcggcttcgtggaactgggagccgaaggggcctcgggcgtcggattgcgatgtttcgagacggtgcggggcggcggaatgaccctgtcgctgcagaccgccacggcctatcgcctggaaaccctggaactggtggccgaggccattcgcgccaatttccgcgacgtgtcgcccgacactgccgatctgatggaaatttccctggccgaggccctctccaatgccgtcattcacggcaacctcggcatccccaatcatttgcgggccaccgccgagggtttcgtggaatttcaaagaatcatgcagcggcgcatggccgatcccgccctgtcgtgccgccgcatcgagatcaacgtgcatgcccgccgcccggactgcatctgcatcgcggtcaccgatcagggcggaggcttcaatctggaagaaaagctggcccataccgcccacgccaccgccaagaacggccggggcctctgcctgatccgcaaggccacccattcgttgcagggcgaagacggaggacgaaccctggcgatgatgttttcccggtagagcgcacccgttacaaaacgtattttttcgccctatcgcgacactcgcctcttgcattcccacgggtcccagaggtaaggcttctgcctgaactcggcggaccgcagggccccttgggggccgcgtggggtggatttgcggcaggtggcatcggacgtcgagacgaggaggacggtagcatgcagtttcgtgtgaaggatgatggtacgggcgtccatgtgtcccttgatggacagttgaacttcgccgcaaacgaggacttccagtccctgctcacgcaattgggcgggcttaagggccgcaaggtcacctttgagatgtctggcctcagccatatcgactccgtggggctcggtctgctctatatcgcccgcgaagatctggccgaaaacggttcgtcgatcagtctggccaatccgcgcgacaacgtgttgcgcatgctggaactgaccgaggcccacaagaccttcgaaatcaagcgctgacgccgtcgcctcggaaggggcgaccgtcattggggcggcaacgtccgggggaactcgcatgtccgacggggtgtggcagaatctgagcttgcgccggcgattcatgatcgtggtggggctgggcgtcatcgtcatggctacggtgatcgtggtcttcatcgcccgcttcgaggagcgcgccctggagcgcaagctccacgagctttccgtcaacgagatgacctcgctgcatgcgctgatcgtcaacgtcatggccacccgtcccgaggacggcgacaatatcggcatcaaggtcttcaacaagtggttcgactcccgcaacgtccactatgcgggcaaggtgtggagcgtgtggggtcccaaggtcaccgcccacatgaaggatgtggagccggaccgcgctcccaaggcggcccaggacgacatcgatcgcgaagccctggccaccggcaagccggtcggccgcctggtgggcgactcctaccgttatgccatgcccatcgtgctgggcgtcaccgatggcgccagggacgaggtctgtcactcctgtcatggcggcatgggcatgaccgacggcgaggtcatcgccgtgctgtcctcatccttgtccaccaccgccgagaaggccgagctcaacaacgtcctgatggggctgttcgccttcggcgtcctggccaccctgatctcggtgctgggcgtcaagtccatcctgacccgcgtcatcacgcggcccatcggccgcataacctccctgatggggcgcctggccgacggcgacacctcggtggagatcgaggcccaggaacgcagggacgaggtcggcgacatggcccgcaccgtccaggtcttcaaggaacacatgctggaggccgagcacctgcgcgccgcccaggagcaggagcggatccgcgccgccgaggagcgggcgcgcaccatgcgcgacatggccgaccatttcgaggccaccgtcaaggccaaggtcgccgaggtggaggaatccaccaccggcatccacaagaccgccatgaacatggccacccgatcgggccagagcggttcgcgctcgctcgacgtcagcgaggcggccaacatcaccaccgaacgcgccgggaccgtgtccgacgccacgcggcaactggcgctgtccgtcaacgagatcgcccagcaggtgggggaatccagccgcatcgcccagcaggccgtggccaatgtcaacaacaccgccagccagatgagcggcctgtccgattcggtgcaggccatcggcaacgtggtccagctgatcaacgacatcgccgcccagaccaaccttctggcgctcaacgccaccatcgaggcggcgcgggccggcgaggcgggcaagggcttcgccgtggtggccaacgaggtcaagaacctggctaaccagacggccaaggccactgaggaaatctccaatcaggtttcggcggtgcagacctccacccgcgagatgaccgcctccatcgagggggtggtcgagaccatccggtccatcgacaacatttccaccgccatcgccgaagccgtgcagcatcaggaaaccaccacccgccacatcgccagcaacatcgatgaagttgccgcccaggcccgcgaggtgtcgtccagcgtgtcgaccctgtcgcgctcgtccgcccgctcctgcgccggctcggtccgggtgatctggagcgccaagaccctggccaaggcggtgtcggacctcaagaccgaggccgaggacttcctgcgttcggtgcggggataggcgagtcgatctaggactacttaagtcgcgactctcgacccgaccgaaggtatgatccctccccatgggatgggagggagtccgaacatggacagttggcgcaataatttgaagcgggcctttggcgataccatcggcccgaccactgtgggccttgacgacgtgctggcggccagccggcagatttccaagttcaatcgcctgtcgcagcatctccaggggctcgacgccatggccgcggccaagaagggcgtcggaccggcggagctgtccgctatccgcggcatgcgcatgtcggaaatcgcccccaagcgcctcaacgagctgtgcgagacgctgctgagcgataaggcctgagcgtcgcctttcccgattgccttattagatccccctaaagtagagtgtcctaaaaccgaccccgccatgagggtcaggacaataccaggggggagcttgcccgcatgagggatcctgcagctattccggattccgatctcggccgatcggaagtcaagaccaccacgtgctacatgtgcgcctgccgctgcggcattcgcgtgcatctgcgcgacggggaggtccgctatatcgagggcaatcccgatcatcccctgaacaagggcatcatgtgcgccaagggtgcctcgggcatcatgaagcagtactcgcccgcccgcctgacccggccgttgaagcgcaaggagggcaccgaacgcggagccggcgccttcgagcccatatcgtgggaagaggccttctcgacgctgaccgagcgcctggggcatctgcgggccaccgatcccaagaaattcgcgctgttcaccggccgcgaccagatgcaggccctgaccgggctgttcgccgccaagttcggcacgcccaattacgccgcccatggcggattctgctcggtcaacatggcggccggcatgatctacaccatcggcggcagcttctgggagttcggcggccccgacctggagcgggccaagctgttcgtgatgatcggcaccgccgaggaccaccactccaatcccatgaagcgcgatctcgccgccttcaagcgggccggcggacgcttcatcgccatcaacccggtgcgcaccggctacgccgccatcgccgacgaatgggtccccatccgtcccggcaccgacggcgccctgatccttgccctggtgcgcgagatcatggaactgggcctgttcgaccgcgacttcctgatccgctacaccaacgccgccgaactggtgaaccaggacgccgacagcgacaccttcggcctgttcgtgcgcgagggcagcgtgccggtgcgtcccgacaccttcgagaccccggacaagatgtggtgggaccgcgagtccgaccggccggtcatcgcccgcaccaaggacaccgagggccgcctgttcggctcgtacaagctgcacgacggcacgccggtcaagccgtcgctgcaattgctcaaggagcgggtcaaggactacaccccggaatgggccgagggcatcaccggcattcccgccgccaccatccgccgcctggcccacgagatgggcgtcacggcacgcgaccagaccatcgagctgcccatcgcctggaccgattgctggggccaggagcatgacaagatcaccggcaacccggtggccttccatgccatgcgcggccttgccgcccattccaacggctttcacaccatccgcgccctggccatcctgatgaccctgctgggcaccatcgaccggccgggcgggttccgccaccgggcgcccttcccgcgccccattccgccctgccccaagccgcccaagggaccgcacgccatcaaggccggcgagcccctggccggaccgcccatgggctggcccgccgaccccgacgacctgtcggtggatgccgaaggcgagcccatccgcctggacaagggcttttcctgggaatacccgctgtcggtgcacggcctgatgcacaacgccatcaccaatgcgtggcgcggcgatccctaccccatcgacaccttgttgctgttcatggccaacatggcgtggaactcgtccatgaacacgtccgaggtgaggaagatgctcaccgacaaggacgagtcggggcaatacaagatccccttcctggtggtctgcgatgccttccagtccgagacggtggccttcgccgatctggtgctgcccgacaccacctatctcgaacgccatgacgtcatgagcatgctcgaccggcccatctcggaattcgacggtcccgtcgattccgtgcgcgtgccgatccttccgcccctgggcgagtgcaagccgttccaggacgtggtgatcgagctggccacgcggctcaagctgccgggcttcaccaacaaggacggctcgcgcaagttccgcgactatcccgacttcatcgtcaatttcgagaccgagcccgggtcgggcatcggtttcctggccggctggcgcggcaaggccggcgagaagtccatggtgggcgagcccaaccccaaccagtgggaccagtacgcccgcaacaacaaccacttccattacgagctgccgcccagcttccagtacatgcgcaactggaacaaaggctacctggaatgggcctaccgccaccggctggtgcgcttcaccgacccgatcatgccgcatatctattccgagctgctgcagaagttccgcctcgccggcgaaggcaagtggaagggcaagcagccccccgatcgcctgcgggacagggtcaagaccttcttcgatcccctgcccttctactacacgccgctggaatggcggtgctcggacgggcatgcctatccgctgtcggcgctgacccagcggcccatggccatgtaccattcctgggattcccagaatgcctggctgcgccagatccacaccagcaacgtgctgttcatgcaccccaaggtgggggcgttgggcaatttcggcgatgccgactgggtgtgggtggaaagcccctggggcaagatcaaatgccaggcccgcttcaccgaggcggtggagcccggcacggtgtggacctggaacgccatcggcaaggcctcgggcgcctggggcctggaccccgacgccaacgagtcgaagaagggcttcctgctcaatcacctgatcagtgaggaactgcccaacatggtgggcaaccagcatgtgtccaattcagatccggtgaccggtcaggcggcgtggtacgacctcaaggtccgcgtcaccaaatgcaagcccggcgaggaaggcgaaagctggccgcagttcaagcccctcgagccgctgcccggccagaccatcggcttcaagtcgaaggttcgtgccttcctggccgggaggaagtgatcatgagcaagaagcaactcgccctggtcatcgacctcaacgtctgcgtcggctgccatgcctgcgtgacatcgtgcaaggaatggaacacctcgggctgggccggtcccctgcccgacctgaatccctatggcgccgatcccaacggcgtgttcttcaaccgcgtccagacctatgaatgcggcaccttccccgacaccgagaccatccacttccccaaatcctgcctccattgcgaggagccgccctgtgtgccggtctgccccaccggggccagctacaagcgggaagaggacggcatcgtcctggtggattacgacaagtgcatcggctgcaaatactgctcgtggtcctgcccctatggcgcccgcgagttcgacccggtgcagggtgtcatgaagaagtgcacgctgtgcgtcgaccgcatctacgacaagaccctggaggaggaccggcgcaagccggcctgcgtcctggcctgcccggccagcgcccgcatcttcggcgacatcaacgaccccaattccgaggcggccaaggccatccgcgataatggcggcttccagttgatgccggaatggggcagcaaaccggccaaccactatcttccccggcgcaagaccaccaccacgctccatccggacgagctggtgcgcgtcgacaacccgctgaaggccgagggggagaaaccccgtcccgccttcaccacgccgaccatcgacggcgcgtccagctggtaaggggagaaagcatcatgaaacccgcattttccgtcatcttcctcaccaccctgatcggcgccggacagggattgctgatcgcgctcaccgccgggcagctttacgccggcggcggcagcggcggcttctatgccctgggcggcgcgctggccctggcgctgctgtgcctggggctggtggcttcggtcttccacctgtccaatccccagcgcggctggcgggccgccacccgctggcgcacctcgtggctgtcgcgggaagtgatcctgctgcccgtgctgtgcggcctggtcttcctctatgccgtcatccacgccttcggctgggcaccggtggtcatccgcctgggcaatggcgccacgctggatctgccgctggtgctgggcctgctggccaccctggcctcgctggcgctgttcgtctgcaccggcatgatctatgcctgcgtgcggttcatccgccagtgggcctcgggctggaccgtggtcaattacctgatgatggggctggcctcgggcttcaccctggccgccgcctatgcccagcttcaggacaacgccctggccggcttcctggccggctcggcggtgctgctgaccctgctggccctggccacccgcgccttccagctgtggcggaacgccaccggccagccgcgctccaccctgaagagcgccatcggcctgcatcactcccagatccgccaggtcacccagggcttcatgggcagctcgttcaataccgtcgagttcgtcgcccccggcggcgccgagacggtgaaggggctgtcggtgttcttcctggcggtgggcttcgtcgctccggcggcgctgctgctggccggcctgccggtgctggccttcctgtgccagttcgtgggcctgctggccgagcgctgggtgttcttcgcggcgggcagccacgtgcagaacctgtattatcaggccaggggatagtctggtttcccgcgggcgacgccttcgtccgcggggcaccgcccatcattgcgccgggtgcaattcctcgactatgggtccggccagacgaagcgcgatggcgcaggctgcctgctcgccgcatcgggtcgagcaggtccggatgctttcgatgatgcgcaggcactcggcgtaatggccctcgccgtacagacggcgggcctcggacagcatggcgatgcacttataggattgtccggtcaccatacgcccctcgccggtcaggcggcgcagtccgccactgcctgggaatagagttgctcgaccaggattcgggccgcgccgggggtcaggctggcatcccgcgccagcagcaccgcccgcgccgcgtcgcactcctcggcatagtccaggcccacctgccgagcggcggcgatggcgcggccgatgatctcgatgagtgacccgttcatatcctgccccgaatgctgtccgttgagacttccatggacgccatgatggggcgcccccacgccaggcaccacctgcgaacggaaagaatgtgtgagtccgtgtaacgaagcgcgaccttttcttcgtcccgaaaacggcgatccggtggcttgacgtccatcaagtaagacggcgacacactatgctaatcagtacattagctgacgctggtctatcctttccacgggaatccacgttgactccacgccaggcggcgcctaaaccagtactcaagcgttgataatcattcgcagcgacaaggttcatgaccagcggcaccttacgtcccagcaactggctgcaagcaatccggtcccggggggccggcatggcgcggttgctgctggtggccttcgcgctgcaactggtaatgccgctgctggacctgggtggggttgccgccctggccggcgaggcggcgcttcgggccgacctgcaatcctcgctgtgccacgattcgagcggcgacccctcgccggatgacaatcccgggccgctgacccaggtcaagcactgcatcttctgcctgcccatggctggcgagtccgccgcctggatagccacaccccaggcccccatcccggccatgagccgcaccgtcaccgtcatcctcagcgatgatcaggtgccgcccgccgcccgcccggctttcgcccggtcaagggcccctccgtcctctcctcgtaccgtctgagcttttcgccccctggggggtgttccacggatttcgaggatcgagtcatgtatttccagctttcccgccgcgcactgctgtgcgccggcaccgcgctctgcagcctgatgattctggccggcgccccggcccgggccgaggacgacgccaccgacatgcccgaagtggtgatcaaggaaaagccctccgtcatggagcgctacaagatccccaacaccgccgaatccatcacccgcgagaagctggccgacaccgtcaacgtggtcgaccccgaggatgcggtgaagtacatgcccagcctgtcggtcaggaagcgcaacaacggcgacacccaggcggtgctgatgacccggacctggggctacaattccagcgcccgctcgctggtctatgtggacgacatccccatttccgccctgctggccaacgacaacaccaggggcggtccgcgctggggcatggtggcgcccgaggagatcgagcgggtcgacatgatgtacggccccttcgccgcccagcatgccggcaattccatgggcggcgtgctgcagatcaccacccgcatgccggaaaagctggaggtcaccgccaagcagaccgagaccctgcaggcgttcaacctctataagaccaaagacacctaccgcaccgaccagagcagttccaccatcggccacaagatcggcgacctgtcgttgttcgtcgccgccaccagcacttacagcgaggcccagccggtcagcgtgctgacctcctccagcgcggtaaccggcaccaccggcgccatctccgccgtcgacaagagtggcagccgcgccgacgtcatcggcatgggcgggctgctgcgcaccgagatgcagaacatcaagaccaagctggcctatgatttcacaccagagctcaaggccagctacaccctgggcttctggcagaatcacggccgctcgcggaccgagagctatctcaaggacgccagcggcaacaccacctacggcgcggccagcacgacgagcaaggccgccaccgccttcgccgggtccaattacatcctggagcaggcccagacctcccacgccctgtcgctgaagtcggacaccaaggggctgtgggacttcgaaggcaacgtcacccacgtccattacgaccgcgacatccagaagcagccgctgggcaccgctggcggcaccaccttcaccaccaacggcaaatacacccagatggacggcaccaactggaccagcgccgacgccaagggcatcttccgccccggcggcctcggcggggctcacgaggccagtttcggcgtccatttcgaccgctacatcctgtttgcgcccacctacaccaccgccaactggcgcaccgaggcgccggtgaccggccgcaccaccgatgcgcgcggcaacacccagacctatgccgcctgggcccaggatgtctggaagctgaccgacaccgtcaaggcgacgctgggcgggcgctacgagtattgggagaccttcaagggctacgtcatgacctcgtcgtcggacttccacgcggccagcagcgaccgcagcgccttttcccccaagggctcgctggcctgggagttcgtcccccagtggaccgtcaccggttcggccgccagatccacccgcttccccaccgtatccgagctttacatgaccagcggcaccggcgtgaacatgaccatcgccaatcccaatctggcgcccgagcgcaccaacacctacgaaatcgccctggagaccagcctgggcgacggcaagacccgggtgtcgctgttccacgaggacgtggccaacgccctgatcagccagaccaacgcggcctccggcggcggcacctcgacctatgtcaccaacgtcaaggccatccgcaatcgcggcgtcgagctcgccgcccagcagaacaacgtggtgatcaccggcctggatctggccggcagcctgacctacgtggatgcggagatccgcaagaaccccgcctgggccggcggcaccgagaccgtgggcaagcgggttcccaacattcccatgcgccgcgccaccgtcaccgccacctatcgccccaccgacgaatgggcgctgagcaccgccgcccgctaccaggaccgcatgcccaccaccatggacaacaccgattacgtcaacaaggtcgccgggtcgttcgacgccttcttcgtcatggatgtccgcgcccgctacaagcacaacgagaacctggaagcggccatcggcatcgataacgtcaacgactgcaaatactatgagttccaccccttcccccagcggaccttcatcgccgaactgaagctgaagctgtaggagcacgccatgaagacccgcatcctcgcgctgctcgtcgccgccctgaccgccccgtcggcccaggcggcggaccacaagggccacggccccaccctgccgccgggctgcgccgccgaggacacaaggctggcctgcgccagtcaggccacgccggtattcctgcccgatggcgccctggtgctgggctgggtggcgggaggacgggtgatggcggcgcgctctaatgatgggggggcaagcttcgagcaagccctgtccctcaacgccgggcgggagaccatcgacgccaatgccgatgcccgcctcgccctggccgccgattccagggggcgggtcttcgccgcctgggccacccgggacaagtcctataacggcaccctggccctggcccgctccaccgatggcgggcggagcttccagccgtcgccccccctggccgccgcggcgcccagccggcgctttcccaccctgaaggtggagccgggcgaccggctgctgctggcctggatcgaaaagagcgcagatccctcccgcaagaccgcccggctggggctggcccgctccgatgacggcgccgagaccctgaccacgcaggagaccgctcagtccgatgtctgcgaatgctgccgcatcggtctggagctgacccccgacggccgtccggtgctgttgtggcgccatgtcttcgcccccaatatccgcgaccacgccgtgatggtcttcgccgaccgcgaccggcccggccccatccgcaagatcgccgaggacaactggcgggtggacgcctgcccccatgtgggccccagcctggcggcgacgcccgacggcgccctgcatgtggcctggtacaccgccggcacggcccgcaaggggatgttcttcgcctccgccgccgggccggaagccccattctccgagcctcagcccctgggcgatgccgccatgacggtgtcgcagccctcgctgctgacggtgcgggggcgcctgtggatggcctggaaggagttcgatggcgagaccaccaccgtgctggcccgccattccgacgattccggccggtcctggtcggccccgcgccccgtcgcccggaccgccgacgcctcggaccggccgatcctggccggcaacggcaaaggcgccctgctgtcctgggtcacccgggccgagggctggcgcctgacggcggtggagtaggccatgctcgcggtgcggcaacgcccctcctcctccaggcgtctggccgggctggccggcgtggtggcgctgcatgccggggccatctacgccctggccaacggcctgggccattgcgccgtcgagatcctgcgcgctccgctggaaaccaagatcgtcgccgagctgatcaagccggttccgccgcccccgcccaaggtggagcagcccccgccgccgcccaaggtggtcaagccgccgccgcccgcctatgtgccgccgcccaagctgcggccccaggcgccgccgccgcccaccgccatcaccgccaccaccgacgtggtccccaccgcgccgccgccgcccgccgccatcgtcgcgcccagcgccgagccggtgcgcgaggtggtcaaggtgccgcccgccctggatcagaaccgcgcctgcaagccgccgcaatacccccccgctgcccgccgggcctcggaaagcggggcggtggtgctgaagttcctcatcgactccgacggctccgtgatggaaagcgtcgtcgacgccaccagcggcttcgaacgcctcgacgaggccgcccgtcaggccctggcgctctgccgcttcaagcccggaaccgtcgacggccgccccgagcgctcgtgggcccgcatccgctatgtctggaaactgcaatgaccggaaacaagatcatgattcgcgcttccctcgccgccctgcccgtccttttcctggccggcgccgccctggccggccatgcggacgaaggccatgccgtcgcccggcaggtggtggacaatccctatggcctggacgccctgtgggcccagggcgatttcgtctccaaggggacgctgatcatcctggccctgatgtccatggcgtcctggtacatcctggtggtcaagctgatcgagcagtcgcgcctgatgcgccatgccaaggccgccgccgccggcttctggaaggccgcctcggtggccgacggcgcccgcgccctggccgaggacagccccttccgcttcgtggcctccgccggcatggaggccgcccagcatcacgagggcgccctgaccgagaagatcgacctcaacacctgggtgaccatgtccatccagcgcgccgtgggcgagatcgtctcggaattgcagggcggactggcggtcctcgccaccgtgggctccaccgcccccttcgtcgggctgttcggcacggtctggggcatctaccacgcgctgaccgccatcggcatcgccggccaggccgccatcgacaaggtggccggaccggtgggcgaggcgctgatcatgaccgcgttcggcctggccgtggccgtgcccgccgtgctgggctacaacctgctggtccgccgcaacaagctggccgccgagaaggtccgggccttcgccgccgacctgcacgccgtgctgctggccgggtccagcggtggcggcaatctgcgcgtggtgcgctgatggccatctccctcggcccggccggcgacggcgaggacggcgacgacgcggtgatggccgccatcaacaccacgcccctggtggacgtgatgctggtgctgctgatcatcttcctcatcaccattccggtggtgacccataccgtcccggtgcagttgcccaaggaggccaaccagccgaccatcacccagccgggcaacgtcaccgtggccgtggaccagaccggccgggtgtggtggaacgaggatgccgtcggaggacgggccgatctcctggcccgcctggatgccgccgccgccaaggtgccccagccggaaatcctcatccggggagaccgcgaggtggcctacgagcatgtgggccgcgtgctggccggagcccagcgggccggcatcaccaaggtcagcttcatcaccgaaccgccgccgcgctgagggtcccatcatgttcgaagatcaggccgaagaccccgatgtgatgatcgacatcaacaccacgccgctgatcgacgtgatgctggtgctgctgatcatgctgatcatcaccattccgctgcagacccattcggtgaagctcgacatgcccgacgggccgccgccgcccgccgcaatcctgcccgaagtggcgcgcatcgacatcgacgcgcagggcgccatcgcctggaacggcgaaaaggtcgccgaccgcgccgagctggaaaaccgcctgcatcaggcggccatggccgccaatccgccggaaatccatgtgcgccccgacaaggccgtggcctatgcccatgtggccggggtgatggccaccgcccagcaccagggcgtcaccaagctgggcgtggtgggcgccgagcagttcctggagtaggcattgcgtcatcccgacgaccatcgggaggagggatctcatcctgccacggcacgtcagaactggcaccaccgtgccaaacggagatccctcgacttcgctcgggatgacaggctccgcgagctcaagtccacatcactcgatcgagaacggatcctcgggcggcaggaccagggtgccggtcatctcggcacagaccgccaggacgatcagggacagcagcagccgcagcttctcgcccccgaggcgggcgccgagccgcgagccgaactgggcccccaccgctccgcccaccagcaggatcagagccaggggaaggtccaccgactgggtggacatggcctgaagcagggtgacgttggcggtgacgaagatcatctggaacagcgaggttcccaccaccaccgccgtcggcatgcccaggatgtagatcatcatgggcaccagaatgaagccgccgcccacccccatcagggccgccaatagtccgccgaacgccccgaccccgagcggcagcagggcgctgatatagagtcccgaccgaggaaagcgggtgcggaagggcagtccgtgccagctgtgatgcacgtggcgcttgcccggcggccgcccggcggcgccggcgcgcatggccagcagggtctcgaccagcatcagcagccccaccgagcccagaaagcccacataggacaggctgatcaccagatcgatctgccccaggcgcttgagcacggcgaacagccagacgccggcggccgagccgatgaagccgccggccagcaggaacagcgccatcttgatgtccacattgcgccgccgccagtgggcgaaaacgccggagaccgaagatcccagcacctgattggcccccgacgccaccgccaccgccgggggaattcccagcatgatcagcagcggagtcagcaggaagccgccccccaccccgaagatgcccgagaggatgccgattcctccccccaccgccagcaggctcaggatgctgaccgattgctcggcgatgggcaggtagatatgaggcaagacctgacctccatgggtgggtcgcgcaccatacaccctcaagatgacgtggagatgacgatccctgcctgtatattatgttttttgcgcatgcgagccctgcatcgcagcttggtcaaacgggcaggtagacatggccctctggcagggcatatacaccctcggtataagggcattgggacgggaccagtaagatgcgtgtgaacgagccgatcaccaaccacgagatcgaacttcccgagggcaccatcctggtgtcgaagaccgacctcggcggccgcatcaccttcgtcaatcaggcctttatcgagatcagcggctataccgaggaggagctgatcggggcgcctcacaatctggtgcgccatccgcatatgccgccggtggccttcgccgatctgtggaacaccatcaaggccggcaagccctgggaaggcatcgtcaagaatcgcgccaagaacggcgaccactactgggtgcgggccaatgccacgccggaaatggagggtggccagatcaccggctacatctccatccgcaccgcccccacccgcgcccaggtcgaggcggccgagcatctttacgaacaggtccggagcggcaaggcccgcaacatcaaggtcgaggaaggccgggtcctgagcactacggcggcggcccgcctgggtcgcgccctcaattccatttccgggcgcctcgccctgatcatcgccatcatggtcatggtcatggggaccgtcgcctggttcactctggacggcatggccgattccaacgaggctctgaagagggtctaccagcagcgtacagtcccggcggggcaattcgtcgagatcatcgaccgcatgcgcgaaaacctgctgctggtccaccagatgcagatcgacctgaacaacggacaggccgacgccattccccgccggaccttgcgcgtccgggccaatgccgagcacatttccgcggtttggtcggcctatcgcgccaatccgcttccggcggaagaggccgaactggccggcgatttcgagacgcggcgcaaggacttcgtcgagcagggcctgctggtcgccctggatctggcggaaaagggcgacgccgccacgctgggccgccatatcgccaccggggtgcagccccagttcgagcaggtccacgaggtgctgaaggatctcctgagcctgcaactgcgccaggcctcggaactctacgagggcgcccgcaccgattacggccaccacatgcggctggggatcggcaccctggtcggcggcaccctcctcgctaccctgatggccctggtgctgatccgctatctgcgccgacccatcgccaccctggaatatcacttcgacgccatcgcccgcggcgacttcacccacgaaatccaggccgaggaagtccgcgagttccagcgctccagcgccttgctgcgcgccatggaggccaagctggcctacgccgtccaggaacgcgccgaaaatgcccgcaaggcgcaggaaaagctgcgcagcgagatgctgaacctcaccgagctgctggaaggcgaggtggacaacacggtggcggaaatctccacccaggccgagcgcctgaaggaaggcgccgcccatctgctggccaccgccgaggaattgcgcgacaaatccgagaccgtggcccgcgccatcgagatcaccagcggcaacgtccagaccgtggccggcgccaccgaggaattggaagcctcgtcgcgggagatcacggcgcgcatccagagcagttcggaacacagcgaggccgcaagacacagggtggacgaggccagcagcagcgtcggcacgctcaccgaggccaccgcccgcatcggcgacgtggtcagcctgattcaggccatcgccggccagacccgcatgctggcgctcaacgccaccatcgaggcggcgcgggcgggcgatgccggcaagggcttcgccgtggtcgcctccgaggtcaaggggctggccgagcagaccgaggacgccataggccgggtcaatgcccaggcccgcgacatcgagagcaccacgcagaaggccgtggccaccgtcgaggccgtggccgacaccatccgcgacatggagcagatcgccggccagatcgccgcctcggccgacgaacagcgcgccgccaccggcgagatcatgagcagcgccgtccaggccgccgatcacacccgcgacgtggccgacgccgccgccgacgtgctgaaggcctccgagcagaccggcgtgaccgcccgcaaggtcagtgaactgtccatgctggtcaaccacgacatcggcgcactgcagcgacgcctcaacgtcatcttgcgcacctcctatggcggcaatcgccgcgccgtcgaacgcattcccgcctcgctggaattcaccgccacctttgccggccgaaccttcagcggccacaccggcgacatctcgctgatgggcgcccttctggtggtgggcgacgcccccaagctggaaggcgaaatcggctccatcaccttccccggcgtgggcgagatccccaccaaggccatcctgggcagccggctggggattcagtgccagtacctgaaggtgggccaggacatcaaacagcggctcagcgccgccattcaggcggcccaggccaacgatgcccccttcatcgccaccgcccagaaggccgccgccgacgtcgcccgggccttcgagcaggcggtcaacgcgggcaggatcagtctggccgagctgttcgagtgcgaatacacccctgtcctcgacaccgatccgcaacagatgctggcccatcacacccaggtggccgaccaagtgatccccgccatcatcgaaccggccctggcctccgattcccgggccgtgttctgctgcgtggccgaccgcaacggctacatcgccacccacaacaagatctattcccagccgcagcgccccaatgaccccgtatggaacacagccaactgccgcaaccgccgcatgttcgatgaccgcaccggcatcctggccgcccgcaacaccaaggaatatctggcgcaaacctatgcccgcgacatgggcggcggcaatttcgtggtgctcaaggagatcgattgccccatcaatgtgggcaaccgccactggggctccgtccgatatggcatcaagctgtagaaggccatccctcggggcgttgcccgattgacagcccttggcgcccccagattatattgccatggttctaaatcattcgagggggtatccatgggaaggtttttcgccgcgctgctgctgtctggaatcgccagttcggccctggccgccgaggccaagcaggacttcaccctggtcaacaagaccggctacgagctgaacgccgtttttgtctcgcccggccacgccgacgcctggggtgaggatgtcatgggccgcgataccctgggcgacggcgagtccgtccacatcaccttcaagcgtgctgaaaagacctgcgaatgggatctgaaggtggtctataccgtcgatgattccaaggccgtctggcacgacatcgatctctgctcggtcagcaagatcaccatccgctacaacaagaataccgacaagaccactgccagctacgactgatcccggccgtcttcaaaggcaagcaacgaaaaagggcccggagatcctccgggcccttgatcttttcggctgtcgccaaacccagtttaacgcttggagaactgggtcgaacgacgggccttgtgcttgccgtacttcttgcgctcgaccacgcgggggtcgcgggtgaggaagccgccggccttcagcgccgggcggtggcccgggtcgaaataggtcagcgcacggctgatgccgtgacggagcgcaccggcctggcccgacagaccaccaccggtgacggtgcagttcacgtcgaactgaccctcgacccgcgcagcctcgaacggctggttgatgatcatgcgcagcaccggacgggcgaagtagaccggcagttcacgaccgttgacgatgatcttgccggaaccgggcttgatccacacacgggcaacggcgttcttgcgcttgccggtggcgtaggcacggccctgggcgtcaaccttgcgcacgtgcacaggctgggcctggaccggcgaggcggcctgcaggtcggccaagctggagagatcggccatgggactacctcttattcttcgggttcatggacccaacgtccaccacctcgggcgcctgggcctcgtgcgggtgggcggggccggcgtagacgcgcaggttcttcatctgctgacggccgagcggaccacgggtgatcatgcgctcgacggccttctcgatgacccgctcggggaagcggccggacagcagctgacccatggtacggtccttgatgccgccgggatggccggtgtgccagtagaagcgcttgtcggcgagcttgttgccggtcagcttgaccttctcggcattgacgataatcacgttatcgcccatgtccacatgcggggtgtaggtcggcagatgcttgccgcgcaggcgcatcgaaacgatgctggccaggcggccgagcacgacgccgtccgcgtcgatcacgacccacttcttctcaacttcggacggtttggcgttaaaggtcttcatggcacccacggcaaaaccagttggcgaccccccgaaaagccggggcgtcgagggcgcggagtatgccacagcgcaccaccaagtcaacaccatttaaatcgtttaaaatcaatatgttagagatgcggtatcataatacctctcgcagaccccgcactaagccttggaaacaaccactccgaaacacgagccttttcccggaatcgagcgcagctccagggcgtggcccaagagggcggccatgcgccgcaccacgccgaggccgaggccaaggccccggctgccgccccgctccgccggggtatcgagacggacgaaatcctcgaacaccgcctcggccttgtcggcaggaatgccgatgccgctgtcgagcacctggatcaccacctgcccaccccgccggcgacagcccaccagcacccgaccactcgtcgtataacggatggcgttgaccagcaggttgcgcagcagccgttcgagcagcaccggatcgctgcgcaccgtcaaggaggtggggatcacgccgatggctaggcccttggcgctggcctccggttcgatctggtccaccagacccgccagcagcggcattacgcggaagtcgctgacattaggcttgatcttgccggcctccagggccgagacgtccagcagggtggccagcagggagttggtggcctcgatgctctgacgcaggcggtcgacgaccttgaccttgcgcggatcgtcctccacctgcccggccagcacctcgacgaacatgccggcggcctgcagcggctggcgcaggtcgtgggaagcggcggcaaggaagcgggtcttgctctcgttggccaggcgggcctcggtggcgcgctgctccgcctcggcggtccgcgccaccaccgtctcctccagcgaggccatggcctgctcctcgcgggagatgaccttgaaggtggtccccgccatccaccccagcccaagcagaaccaccgccagggcgccacagatgaccagggcggttcgccgccagggcgcgacgatgtcgtccaccgccatgccggcgctgaccagtacgtcgaactgggccagcttgcggtacgacaccacccgttccaccttgtcgatgggcgagtcgatgcggatggttcccacgggctgggtggcggcggcggccatgaccggattgttgggcggcaggcgccccacgtatttctcgggattgggctggcgcagcatgatccggccggcggtattggcgccgatatagctggattcgcccagccccagggtattgtagaaatcggtgaagaagcgggcattgacccccaccaccaccagaccgccaaagccgccgtcgggggcgttgacccgccggctgatcgtgaagaccggcgcctgactgtagacccccaggaccatgggaccgatgaaacgctcggcgccgtcgcgatgggcgctgaaatagtcccggtgggcgtaattcacggccccgccggccttgggcggcctgacggcggcgaccacgtcgcccttggcgtccaccaccagcatgttgccgcgctgggtcaggccggcttccaggctggccagttcccgcagcagctccgcgcggccgattcgcccggcctgattctcctgcaccaccacaaccatgcgggcaatgatggcgtcggtggtgacgagggtgcggctgagattgtcctcgagcagacgagccgctccggccgtggcggattccgccttctcgaatgcggcatcacgcagttcgaccagcaggccggcggctcctcccagcagcagcacgaccatggcgaccatcagcaagcgcagacgcgtccgcaaccccccaggggtgcggcggaagcattgctgacctttggttgcaaaagactcggtgggcaccgaggcgattccctggtggaaaaggtgatggtcagcttataccgaaaggccggtggccggaagcggcataatgcctatgcctgcgccgcttccagttcctcctgggcggccagccaggccagttccgcctcttccacccggcgggcgagatcggcttcctggcgccgcagttcggtgaccttggcgggcggcccctggtagagcttggggtcggccaattgcccgctcaggaccttttgggccttgaccaaatcctccagggccttttccgccgccagagccgccttgcgcagcggcgccaactgggcgcgggcgccggccgccgccttgcgatcggccttgcgctgggcggcgtcgccgacccgttccggcttggccccccggcggtcctcgcgggcccggtcgagcaacagcttgcgataggcggccagatcgccatcgaagggcttgaccgcgccatcgcccaccagccacaggctgtcggcggccagctcgatcagatgggggtcgtggctgatcaggatcaccgcgccgtcataggcgttgagcgccgccaccagggcttcgcgggcgtcgatgtccaggtgattggtgggctcgtccaggatcatcaggtgaggcgcctcgcggctcatcagggcgaagagcaggcgcgacttctcgccgcccgacaggctggcgaccttgacgttggcgcggtcctgctcgaagccgaagcggccaagctgggcgcggaccttggcctcgggcaggcccttcatcagcagggccatatgctcgtagggcgtctcgtccagccgcaattcctcggtctgatgctgggcgaaatagccgatcttcagcttgggcggcttgcggaactggccgctcagcaggtcgaggcgtccggaaaagatcttggccagggtcgacttgccgttgccgttggcgcccagaagggcgatgcggtcgtccatgtcgatgcggatgtcgagccccttcagcaccaccttgtcgccatacccggccacgccgtggtcgatggcgatgatgggcgggctgagcggttcgggatcggggaagtcgaaggacatggcgcggtcctcgaccacggggaccaccatctccatgcgctcgagcatcttgacccggctttgggcctgggcggccttggtggccttggccttgaagcggtcgatgaaggactggatcttcttgcgctgttcctgctgcttggtgaaggccttggcctgcaattccatgcgggcccggcgggtcgcctcgaagcggtcgtaattgccgccataggcgttcagcttgccgttctccaggtggatgatgcggttggccacctcgttgagcatctcgcggtcgtggctgatcaccaccagggtgccgggataggcggccaggtggctttgcagccacaaggtggcttccagatccaggtgattggtgggctcgtccagcagcagcaggtcgggaacggtgaacagcgacgccgccagggcgacgcgcatgcgccagccgcccgagaagtccgagaccggctgcaattgcgcctcggcgtcgaagcccagccccgacaggatggcggcggcccgcgacggtgcagaatgggcgtcgatggccatcagccgctcgtggatctcggcgatgcggtggccgtcggtggaggtctccgcctcctcgaacagggcggtgcgctcggtgtcggcggccagcacgcaatcgatcaacgagatgtcgccctcgggcgcctcctgggccagccggcccagccgggcgcgggggcgcaggttgatctcgccgccatcggggtgcagttcgcccaggatcagcttgaacagggtggtcttgccggtgccattgcgcccgaccaggccgacacgcgccccggccgggatgtgaacggtcgcctgctcgaagatggcccggccgccatagcggaaagtgaggtcgttgatatgcagcatggccgcgtcaatagcacggcggcgccctctcggcaaaggcgggcttgtagagaccgttgctctcctcattcaatgaggttataacccgccgtccccggatgcgcccggccgcgccgggggtcgtacgcggccgcccacttccgaccccaggcgcggcgcgagcaaccgccgaaaggaattcaccaatggccatcgaacgtaccctgtcgatcatcaagcccgacgccacccgccgcaacctgaccggcaagatcaacgcccgtttcgaggaagccggcctgcgcttcgtggcgcagaagcgcgtccagctgaccaaggcccaggcccagcagttctactcggtccatgccgagcgctcgttcttcggcgaactggtcgacttcatgatctccggccccgtggtcgtccaggtcctcgaaggtgaaggcgccgtcgcccgcaaccgcgagatcatgggcgccaccaacccggccaatgccgctcccggcacgatccgcgccgacttcgccgaatcggtggaggccaattcggtgcacggttccgactcggccgaaaacgccgccatcgaaatcgcctacttcttctcgggctgcgagatcgtcggctaaaccgaccgatcccaaccgaccgacgccccccgggaggaagctcccggggggtattttttcttcgaatagacgccgtattgcatacaaatgcgggaataactttttcaacgagtcacattgcgattcttttgttgaaaattgcgacttgcgcggcttgtatgcacagtcccaaataggggccgttacaacctcagcggaggcgcgcaatggataccacacgtcaatcaagccggggaaggacgccgggcggccgccccaatcccatcgatgtgcatgtgggcagccggcttcgcctgcggcgaaccctgatgggtctcagccaggaagccttgggagaggcgctgggtctcacgtttcagcagatccagaaatatgagcgcggtgccaaccggatcggagcctcgcggctgttcgatctgtcccgagcccttgaagtgccggtggaatatttctacgacgaaatgtcacccgacgtcatggcggccagcccgcgccatatggtacgcgccacccaggagccggttccgcagcagatcgaccccatgagcaagcgcgaaaccctcgatctggtccgcacctactacaagatcggcgaccccaacgtgcgcaagcgcgtctacgaactggcccgcgccctggcgctccataccggaggacggcgggagggcggctgaccgccctcggccgcatggcggccgggatcctgccgacagggcgggatcccttacgccgttgtcccagcccccgcctcgaagaagcgacagcatcgcccgcctcgctccttggcctggtacatggcggaatccgcgtggcgcagcagcagcgaggcggtctccccatgctcgggataacaggcgataccgatgctggccgacagattctggggcggatcagtgatggagtagggcacccccagagccgcctgaatcttttcagccacctggcggacgtcgctggcctgcggttgatcgaaaagcagcacgatgaactcgtcgcccccctggcggatgaccacatcggcttcgcggaccgtctgctgcagacggcgcgccgcgtccttcagcaccagatcgcccacctcgtggcccagggtatcgttgacatccttgaattgatccaaatcgatgaagagcacggccatcccacgccccgtccgcttcgccctggcgatgccgtgtccgatgaactggtcgagaacgatgcggctgaacagacctgtcaggacatcgtgagtggccagatattccacctgctggcggctggcccgattgcgccggctgcgttcgcgatcgacccagtgatgggtggcgaagccggccaggatgatcaccagcgtccccatggcgcccgccaggctgaactgccacagccggtcctcgtccatggtggccaagcggtccaccggcgccaagacggtcagggcgagatcatcgtcgggcaggatggttgaaaggcggatgtaaggcacaccatctgccccccagcgatacaggttggggtggtcgggcgccccccacggcacgatgggcaactcgacgaactcggaccgcttgtagcgggcgatcctctcctgcggggacagccccaccacgcccgcgcccggcagcgtggacatctccagccccttgtcctgggccaggatcaccacgccgtaattgtcgctgacgaaggcgttggcctggttgacccaggacgccagatagggaatgtcgaccttcagggccatcacgccaagaatgcggttgccgtcgcgaaccggggcggagaagaacaggcccggaatgttggtattgcgccccagcgcgaactggtgcccgaaccgcccggccatggcctcggagaaataggtcctgtcccgataattggtcccgacgaagctctcggggcggtcgtgattgctggcggccacggcatcgccggcgggattgatcagccagatgacgctgatcccggcaatgtcgcccaccgatgctgcaagcgaacggttcagccggtcaagctgcgggtcggacgacagaccgctccggcgccggtcttgggacagcgggcgcggttcgagaggatcaccgtaccggcgcagggcgtccaccacctcccgatcgcggcccagagccgatggaatgccgtggaagaccgccagtgtccgctgaagaccctgggtcatgtcgtcgatgctcaggtggacgtcgtggtccacttgggccagtgattccctggcccgccagaccacatactcgcccgacaccagccagcaggccaccagccacagggccacggccgaacaggtcagcatcaggaaacggcgacccagcccgggctcggcgcgaaactccagcaccactcccgccggaccaccccggccgtctccgggattgcgggaaatggcaatgggaagctcggtttccatgccccgtcccccctccttccgccttggaaaatagtctgcggagaggccacgaatctacgcattccggagagaggtggaaatgaaaaagcgagacggcgcgcaatacccgcgccggatcgggaattggtttgcctaggccagccacaaaccctggggtatagtttcgcggtaactatcctggggtccgaatgccttccggccacaaatcctcgccactcgccggattacgccctcggggaatttgggggttgtccgtcagcctgaccctgctgctgatcattctgaccggaatacagctccagaccggctatcggcgaaccatccagacggccagcgccaatctcgccgacaccgcccgggtcaccgaggagcaggtgcgcggcagcctgcgggtggtgcgcctgatgctgcgcgccatcgccgaggcgccacgcgacgacaccaacgcgctcagacgcttcatggccacccgaaccagaatcgtccccgaaatccgccaggccttcatcgtcaatgccgatggcatcgtcaccatcgccacccttccccaggtggagggacgggacacaagcgaaagatcgttcttccggaatgcgcgggagttgccgccggcccgcgatcttttcgtctcagagcccctgcccatcggccagaacaacagcctggtgatcatggtctccatgccgctttccggccccgacggccagttcgacggcatcgtagcggtctcactcgagctgggctatttccagaccctgttgcaatcggtgcacagtggcgaggagggggcgggcgcattgctggttaccccggaaggcgacatcatcgaccgcgaccccgagcccgagctctatgtgggcaagaacatcgccaagggcggcgccttctccatgcaccgcaaggccggcggaacggcgaacaccttcgtgcacgtcaccgccaccgatgggaaagagaaggtgtcggccgtccgctccctgtccgagccggccctgccgcccctggtggtgatcgtcggccgcccgttggacggcgtgctggcgccgtggcgcgccgaggcactgaccatggctgcggtggtgggaaccttggttatcgccattctcggcctcaccgccctgctcaaccggcaccttgtcgccctccgggccagcgaggagcgctatcgcggactgatcgagacccagaacgatctggtggtccggcttacccccgatgaccgcctggtattcgtcaacgaggcctttgcccgcagccatggcctggacgccgcccaggctgtcggccggtcgtggcggaccttcgtccacgaggaggatcagccggccaccgcccaggctctcgccaccgccctgtcgccgccggccttccgcgcaacggtggaatgccgcatgacgatgacctgcggcttgcgctgggtttcgtgggaaggggcggctatccgcgacatgtcggggaacatcgtggaaatccaggcggctggccgcgacatcaccgaatgggtggaacaccgcgaccgccaggcggaactgctgcgcaacctggacaagtccaaccgggaactggagcagttcgcctacgtggccagccacgacctgcgcgagccgctgcgcatgatctccagctatctcggcctgctggggcggcgctacaccgccctgctggacgaggatggccgccagttcatggaattcgcccgcgacggggccaagcgcatggaccagatggtcctcgatctgctggagttctcccgggtcggccgcctgcgggacggcctcggcaccgtgtctctcggcgaggcggcatccatcgccattctgaatctcgcccttcccatcaaggaaagcggcggcaccgttaccgttgctccggacctgccggagatcacgggggccaggggtgagatgatccgcctgatgcagaacctgatcggcaatgcggtgaaatatcgccagcccgggcgcccgctgacggtaaccgtctcggcggaacgcaatcatgacggctggaccctgaccgtcgccgataacggcatcggcatccctcccgacggcttcgagcggatcttcgacatcttccagcgcctgcactcccgcgccgattacgagggcaccggcatcgggctggcggtctgccgcaagatcgtcgagcatcacggcggccgaatctgggtggaatcagtgcccggagagggatcgaggttccgcttcaccttgcccgggggccaggcctgatcatccctggcgctcggccagggtgtcctcgatctcgcggtcgtagaagcgctcgaccagcagcttcagccccagggtcaccagggccagcagggtcagcaccgacgccgcggcgaaggcccccgaactgtcatagtcgtgatacagcagatcgatctgcagcggcagggtcatggtctcgccccgcacctggcccgacaccaccgagacggcgccgaattcgcccagcgaacgggcggcgcaaaggatgatgccgtaaaacagcgcccatttgacgttgggcagcgtcacccgcaggaagatggacagcccccccgcccccagggtcagggcggcttcctcgtcatcggtgccctgcagctgcatcagcggcaaaagctcgcgggcgatgaacgggctggtgacgaacagggtggcgatgacgatgcccggcagcgcgaacatcaccttgatgtcgtgctcctccagccagggtcccagcaggccggagccgccatagaccatcagggcggcgacgccggcgacgatgggcgacaccgagaacggcgcctccaccagggccaccagccatttcttgcccttgaagcggaacttggtcactgcccaggccaccgccagcccgtagacggcgttgacgggcaccaccaccgccaccaccaccagggacaggccgatggcgtgcagggtctcgggatggctgaccgccgcccaccacgccgcccagcccttggacagggcctgggcgaagatcaccgccatgggcaccatcaggaagcccagggccagcagcccggccagcccgatcagcagggcgcgccgggcaccgccgggacgacggcggggaacgtggtgaacggccatggcgggaatcatcgtctcacccctttgccaggtagcgctgctgccaggcctggatgccgttggtcagcagcatggtgacgaaggcgaaggccagcaccacggtggcgatggcggtggccgagccgaattcgtattcctccagcttgatgaagatcagcagggcggcgatctcggtctcgaacgggcggttgccggcgatgaagatgatggcgccgaactcgcccaggcagcgggcgaaggccaggggacatgccggccagcagcgatggcgccagggtgggcaggatcaccttcaggaaaatctgcatctcggaagcgcccagggtgcgggccgcctcctcggtctcggtctccagttcctcgatcaccggctgcacgcttcgcaccacgaagggcaggctggtgaaggccatggcgatggcgatacccggctgggcatggaccaccttgaagcccaggggctccagatgctgacccacccagccgttgggagcgaaggcggcggccagggccaggcccgccacggcggtgggcatggcgaagggcaggtcaatcagggcgtccagcaggttgcgcccggcgaactgatagcgggccagcacccaggcgaacagcagcccggccagaccgttgaagatcaccgcctcggccgccgacaccagggtgacctgataggcggccagggcgcgcggcccggtggtggcggcgatgaaaccctccaggctcatgcccgccgccttgaccagcatggcgcccaggggcagcaggacgatcaggccgagataggccagcgtcatacccatggtcaacgagaagccgggcaaaagcctgcgggcgcgcatcatgcaaactccggtgggacctgtctggccatcacccggcggagcaccgccgggtgagagaccttttagccggatcgcgccggagacgcatcacttcttaccgaagacctgatcgaagattccgccctcggcgaagtggatcttctggatgttgtcccagccgccgaacagctcggtggtgtacaggcgcaccttggggaaggcggccgcatgccgggccgccaccttctccgagcgcacccggtagaagtttttggccaggatctcctgtccgtcatcggaatacaggaagtcgagataggccttggcggtcttggccgagcccttcttggccgccaccttgtccaccaccgccaccgggaattcggccaggatgctgaccggcgggatcacgccttccaccttgtcggcgccgaattccttgatcacgccgcccacctcggcctcgaaggtgaccagcacgtcgccggtggcccgctcgacgaaggtggtggtggcgccacggccgccggtgtcgaacaccggcacgttggccaccagcttgcggatgaattccttggcctggacctgatcgcccttggccgcctccagcgcgaaggcataggccgccagataggtgtagcggccgttgcccgaggtcttggggttggggaacaccaccttcacatccgggcggaccagatcgtcccagttcctgatgttcttggggttgccctttcgcaccacgaaggccggcagcgagtaatagggcgaggcgccactgggaaaggcggtctgccagtccttgcgcacgaagcccttgtcggccaggacctggacgtcggtcacctggttgaaggtcaccacgtcggcgggcaggccttcgaggatggcgcgggcctgcttggacgagccggcgtggctctgcttgatctcgatggctttgccgtcggcgagcttgcccgccggggtggcctggaaggcggggttgatctgctggaacagttcgcgggcgatgtcgtaggacacgttcagcaactcgcccggcaccttgtcctcggccgaggccccggccggaaccagggccaaggccgccaggacggcgagagtgggaaagcgcaaagccatgggaaactccattcggtgatccttgggttaaaacacgaatatcatgtgtcgtttattttaaaaatacattttttatgagttatttcggcgaggatacgcatcttcacctaaaggtgatagagcgccccgtcaccagacgctcattgactccgcacgtatccttgggaataagcttgtggggaatacttttggagaaggcccttcacgtgtcgatcacgccggaatcgattctatcatctgttgtgctgctgaccgagcagcgcagccagaagcacctggaagactgcctgaccgcgaccctggcggagttggccgccctgccgttctgcggcatctgcacccccatgcccaccgccaacggcatcttcatcgactgggccgccagccgcagcagcggcggcagcgcgccctcggatgaattgcaggaaatcggcaccgaccccctgctgctggactgcatggccctggggaccgaacgcagcgagaccatggccgacgacagcatccgccgcgcccacccggtggtcgacgaccgcggcaaggtctgcgccttcctggtaacccgcaccaatcccggccagaccgagcccgaggcgctgatcaagggcttcgtcgccatctaccgcaactacctgaccgtcctgtgggacgcagcgcgcgacaccctgacggggctgaagaaccgcaagaccttcgacgagaacttcagctccatcgtcctcgaaagccgccacatcgatgtgtcgttcaacggcaaccggcgcgaagcccatctggatggccagcaccactggctgggcatcatcgacatcgatcgcttcaaggccatcaacgacacccacggccatgtgttcggcgacgaggtgctgctgttgctgtcggccctgatgcgcaaggccttccgcagcgaggataagctctttcgcttcgggggcgaggaattcgtcgtcctgctggctcccaccaccttctcggccgcccaggcggtgttcgagcgcttccgcgccacggtggcggctttcgccttcccggaagtggagcgcatcacggtcagcgccggcttcgtgcgcatcgactgcgacgacctgccctcggtggtgatcggcaacgccgatcgcgccctgtactacgccaaagcccacggccgcgaccaggtccgctcgttcgagcaactggtggcggagggggaattgcccttcgaatgcccctcgcttgccaagaccaagctattctgacttgactctgctgtcgggatcagtatggtgcgcgcctcaagttttcatcaccaacgctgttcgggattttcgccatggccaagcctgccaccattctcatcaagctgttgagcaccgcggggacgggcttcttctacgtggcgaagaagaatccccgcaagacgaccgagaagcttgaattccgcaagtacgatccggtcgtgcgcaagcacgtccagttcaaggaagccaagatcaagtagtcgggcgccggtcgcaggaccggcagcgacagcaaggatcaaagggcgccttcgggcgcccttttctttgtccgcgaccgggtgtcatcccggacgcatgcgaaggacctccccctcccgagggttgccgggatgacggactccgccgctcattttttcgggaaaaagcgagccctattccaggaagcgcgccacggtctgcaggaaattggccaccgagatgggcttggcgatatagccctcgcagcccccctcgcggatcttttcctcgtcacccttcatggcgaaggcggtgacggcgaccaccggaatggatttcagttcggcatcgcttttcagcatcttggtgatttccaggccggaaatctcgggcagctggatatccatcaggatcaggtcgggatgatgcttgcgggcgatatccatggcctcgcggccgtccttggtctggatggtctcgtagccgttggcctgcagcaaatcgttgaacagcttcatgttcaagtcattgtcttccacgatcagcacagacttagccatgaccatcctattttgccgacggcccccactgaccccaatgccataggccgcccatcacgttggcatcatgggcaattcccgcccccaagtcaaatccgagcatgatcaccggctaaccaaccgcccacacccagcaacagccaggacgtcatcaaacttattccaccaaagggtgttaccatcgggaccggcaggccgacccctaaagccttcagatagagggagccgcaaaacagcgcaatgccggccaccatcaggcatgcggcgggacggaacagccgccgtccctcggcgcaatggcgggccagggccagcagtgccgccgcgtgcagcaactggaactgactgcccagcgccacccagcgggcggcatcgccctccaccccatgcgagccccaggccgcgaagccgatggccatggcgccattgatcccggccagcatcaaccagacacccatgcttttaccctccttgaccgcccctcggcgcagtacgaaataacgaagcgagtttgcccggcaaaggggggagttgggaatgcctgttccacaagcgctggccgccgtgatcctgggaatcatcctgctggcctccggtgccctggcgacggaaccggcgggcaaggtcatcggcctgcagggcagcgcagaggcccgcgatggcacccaccgccgccccctggcggcgggagaccccatccggaacggcgagtccctgcacaccggccccggcgcccggctgcaggtccagctccacaacggcatggagctgaccttgaccgacgaagccccggcggcggaaccggcaggcagggttatccgcctgcaaggcagcgccgaggcccgcatcggcgtccaaagccgtcccctggcggtgggagaccccatccggagcggcgagtccctgcgcaccggctccggcgcccggctgctggttcagttcagcgatggcatggaactgatcttgagcgacggcgccgagatgaaagtggccacctatgagtggaatgccgcccaggcggctggcgcggcggaactggccctggcccagggctcgttcctgctgcgcaccggcgcggtgggcaagctgcccgaccaccccctgacggtgaaaacgcccctggcctcggtcggcgtgcgcggcacccagttctggggcggcccgctggatgcgccgctggccgtgctgttgatcgacggacgggtggtggtgaccagcccggcgggcagcgtcgaactgggaacgcccggtgaaggcacctcggtgagcgggccgggcaaggcgcccatgccgccctcctattggggggcggagcgcatcgggcgcgccttcgccacggtcggcttcaaagactgactaccggaacaccaccgtcttcgagccgttgagcagcacccgatgctcggtgtgccagcgcacggccccgtcggccttgccgacggatcgtcacgactcgcgccgggcgctggcgtcagcggaacaccaccgtcttcgagccgttgagcagcacccgatgctcggtgtgccagcgcacggcgcgggccagcaccacgttctcgatgtcgcggccgatggccaccagatcgtcgggggtgtgggtgtggtcgacgcgctcgacgccctgctcgatgatgggaccctcgtccaggtcgggggtgacgtaatgggcggtggcgccgatgatcttcacgccgcgggaatgggcctggtgatagggcttggcgcccttgaagctgggcaggaacgagtggtggatgttgatggccttgccctgcagccgcacgcacatgtcggtcgacaggatttgcatgtagcgggccagcaccaccaggtcggcgtcggcgcgttcgatcacctccatcacccggttttcctgggtcagcttgtcgtgcttgtccaccgccaggtagtgataggggatgccgtgccactcgacgatggagcgcatctcctggtggttggagatcaccgccggaatctcgatgggcagcgaaccggtgtgatagcggtgcagcaggtcgttcaggcagtgcccgaacttggagaccagaatcaccacccgggccttctgccggccgtcgtgcagcttccagatcatctgaaactgggcggccaccccggtgaacagcttttccagctcggccatgggcggcgtcatggcgcccgccccgaatacgatgcgcatgaagaagcgcgacgacagcggatcgccgaactgggccgcctcggtaatgaagcagtcatgggtgctgagaaagcccgatacggcggccacgatcccgacagtatcgggacaagtgatggtcagcacccaggcgggcttgtcggccatgatcaggctccttgttgcaatgaccccatgggtttatccgaccccgccccaatgggcaatcccgcccttgccttttggccgcaaatgcccgaaggtccggtgcgaaccataaggccacggagcaggcttgatgatcaccgtttactacaagtcgggcaatgcccagtggaagtacgagctggaagattccgagcacgactacatcatcaagagcgtcctcgaggacaagcccgacatcaacgagatgttcgaggactcgctggagatcctgcgtgacatatcggccatggacgagtccgagatggaagaggacgacgagatcgaccagaccatcgccgtgtccttcctgtggcactacttcaacaatctggttgaaggcggcgaccgcatcgagggcgacatcgtcctgatcgaggacgaggacggcaccggcgtcaccgtgctgcccgccgccggcatcgacgaggaataatccccggaacaagaaaggccccccggtcaccgccggggggcctttagcgtgtccggggcgcctcagcccacttcggcgcggtagatgttggccagttcctcgtcggtctcgggatcgaccagggaggaaatggcggccagcaggcccatctcttccttctggatgtggaagatctcgcgctcgaccagctcggcgccggcgtccttgaactcggtccaggtggcatcggtgaagccggcctcggcggcggcgacggcaagatcggccacctgcagcgccagcggcaggatcgagcggtgctcgtgggtcagcatggtgacgatgccggtctcgccctgctcgacgaacaccttgaacaggtgattttcctcgaagccgaaatggctctccacctccgatttgaggatgcgggccagctgcttgagctggcgggccagcaggtcgtccttggccggagccttcttgttggagccgagcatctcgtccagcgactgcagggcctcgatggtggtcatgtgggcctgatgcagcagggcgccggtctgggtgttcatgggacgcttatccttgttgatgggccgcggcggcggcggccatgtgggaacgataccggcgcagcacctccacggtgtagacaccgaaggcgaccgcgccgaccagaccggcgatcaggcccagccgcagcggccagacccagccgccgatcagggcgacgcaaaccagaaccagggccgccgcgtggcagcccagatgaatatccaccggcagtttgggcgacaggtgcgacagcaatgccggcttgccgcccagggccgaggaatgcatggaggccagaaatggcatgatccgctggaggatcgccgtgacgaaggacaagagccagccgaaaaccagcaaaaatccccacaggctcgcccaggggtcgagcggcgcccccagggccggggccagcccggccagcaggctgacgggcagcagcgcccaggcgacccataccacgcggaagaacggctccaggcgcttcttcatgcggctcttcaagctggcccgcatgccgtgcaggtagacgccgcaggccgccagccccagaaggatgcccagcgccgccaccagcccctggccggtcagcgcgccaccggcgcccagcgccagtccaagccccgacagcagcgccgtccgcttgcccaccacgtcgggaaccgccgagcccagcacgaacatggggatcagcacataggaaaagcccagcgccagcatgcccatgaagccgtagccggccagcacggcgtgggccgccgccaccgaggcgtggtcgggcaggaagcccttggtgaaatccaccaccagaaccagcccgaggacggccagaccgatcagcgacgccaccgccagccaggcatgacgggtgacgccgggcagatcgtcgaccttgcgcagattggcccccaccagcccgccgaacagggccaggccggcgacacagagcgtcgcgccgccatgctgggcccaggggatggaatgggcgaggccgccggcgaacagcgccacgccgggggcataaaggatgaacatcagcttgatggcccagatgggacccagcggccggcgcgtcgccaccggcagcaattggatggcggcgcccatggcggtcatggccagggtgcccagggtgatcagatgcagcgccgccagggtcatgccctggccgccgacgaagccgatcacgccctcgttgccgaccagcagcagcacccaggccagcaggtggaagaacaccgccgccacgaagaagcggtaggggatggacggaggcaggaggcgatccttcgcccccatcatgaagctgccgggaaacatcagctttcccgctccagccacagcctgacattgacgacctcggtcgagacccgggcgatgcgccagccgcgctcggccagttccggagcgaggaaatggggctcgcgctcgtgatgcaccaccacaatctcgccgggaccggcgccttcgatcagccgcaggatggccagcatgggattgggcggagtgagcttgcgcacgtcgatgtgcaggccgtcctcctcgcgccaggtcatggcgccctctggccccacttcgacctcggcgccgctttcccagtcctcgccgccgtccaggtggaagaacacccgccagtggccttcgttcagcttgcggccataggaggaaaagccccgcgccgccaggatgcgccgcagcggcgacggattgaagggcgcgtcgatcaccagcacgccgccgaactcgatcccggccacggcctccatgacggcggcgaagggatcgacgccctggaccagcagcggccggacgtccatgggcggagattcgagcgccagggacagccattccggcggcccaccagcctccttcccttctccactcaccccttcaacggccatgtcacataccttccgcaaggatggtgcaaagctgcccgtccgcccggagtgccgccttgacgtttgttaagccgacaacttctgtgcggattggatgcatttaagacggtgacggaacgccccgctactccccgcttccctcgcggaccatgcggcggagtgcctccacatcggtgatctccacctcgcggccatgggtatcgacgccataggccttgaggcggttgagggcgcgcgacaggctttccggcgcgatgccgatccggctggccagcaccgccttggtcagcggcaggcgcacgcggccggcggcgtcggcccccgccttggcggccagggccagcaggaaggtggccagacgctggccgggcgacttgcttttcagttcgctgatctcgtggatcagacggaattgccactgggacaggccgcccagcagcatcggccccagcgagcggttgtcggccagacgcttgaggaattgcgcagccggcacgtgcaccagccgcgagccggccatcacctcgccgttcagcggaaagatgcccgacgagaagatggcggcctcggcgaaggagacgatggggtcgaacacctcgatgatggactggtcgccggtctcggtcagggcgaagatgttgacccggccttccagcaggatgaaaaagcggtcggccttgtctccctggctgaacagcagttccgtctcgggataggcggcggaatgggcgccatccatcaacagggcgaggtcggccgaggacagccccgccagcagcggagcctgggccacgagttccagttcggcggcgttgagtgccatgggccttatcccacctcttcttcggcgcagaattcgcgcaaggtggccacctcggcgatgaccaccagattgtcgggcagggattcgacgcccagccgccccagcttgccgagcgcccgcgacaggctttccggcttcatgcccaactggtcggccaccagcttcttgtcatagggaaagcgcagctcggcacggccttcctcggcctcggtcatggtcagcaggaaggagcccaggcgctgggccgtggtcttcagcttcagctcggcgatctggcggaccagcatgcgcaggcggaagctcatggtggtcagcatgtgcagcgtgatgtccaggcgctcttccaggcgggcgcggaaggactgggccggaatggacagcagggtggcgccggtcaacacgcgggcggtcatgatgtaacgcccgggcccgaacatggcggcgtcgcccagcacggtggagcgccgcgccacttcgaccacgctcttcttgccgtccacgtccagcgacagctccacgtggccgtccagaaccacgtagaagcgatccaccgcctctccctcgcggtagagaaggtgctcgtggcccaggaccagcagttcggcgccctcgagcaattggcggacatccctctccgccagcccggtaaacagcggcgcgaattgcaattgcagcagcacctcgcggtccagcgcctgcgtcataagcggttccttatgtgactccggtcaaccggcaggcaccgtacgacgaagcgcgggcctgttccagcccctaaatgccgccccttgccggaggtcggatggaggtctaagtatgcatctggcctaattttccgatccggacatcatgagcggcaaccccacccttcccatcggtattttcgattccggcgtcggcgggctgaccgtgctgaaggcggtgcgcgagcgcctgcccggcgagtcgctgatctatctgggcgacaccgcccgcctgccctatggcaccaagagcgcccagaccgtggccgcctacgccctggaagccacccggcggctggtgtcctacggcatcaaggccctgctggtagccgacaacacctcgtcggcccatgccctggagggcttgcgcgccgcctttcccggcctgccggtgatcggcgtagtcgagcccggagctaccgccgccgccgcggcctcggcccgcggccgcatcgcggtcatcgccacggaaagcgccgtccaggccggcacctatccccgcgccattctgcattcccggcccaatgcccaggtgacgcaattgccctgcccgctgttcgtctccatggtcgaggaaggcctggtggacggccccatcgccgaacagattgcccgtcactacctggacccgctgttttccggccccgacgccgccgattgcctgcttttgggctgcacccactttcccgccctggcgccgctgttccgccggctgctgggccgggacgtggccgtggtggattccgcctcgaccaccgccatggtgctggaggatctgctgagcctgaggggcctgcgcgccccaggcggcacggcgcgggtgcgctatctcgccaccgatgcgcccgagcgcttcgcccgggtgtcgcgggtcttcgttccctggatcatcggggaagccgaggtcgagtccatcgatctggggtaaacgattgtcatccagagagagcggaagcgaccgagggatctcatcctgatccggtgggttcgattcggcaccgtcggtccaggcggagatccctcactgcgttcgggatgacaagaaaaccgcgctcagccccccgccgccttcagcgcggcgcgggcctgggtcaggcgggcatagagatcgtggcaggacgccgccacgtccgggatcttctcccagccgatgggcagttcctcggacaggtcgtgcaggtccatcttggcctgggtcgcctgggcgttcagcttcttgacctcggccttgagggcgtcgacgtcgctcatggggggaatactccggtcttgaggggcgtggcggcaggccgagtgtagccttgccccacccgccccatcaaccggcgagacggtaggtctggcctgcgtccacgcccagcgccggcagcgagcccgccaccggggtgccctcgacggcctcgacccgggtgcggaagcacgacaggcaccacaggaccggggcgagcaccctctccctgaccacggaatgccgggtgcggcgaccgcaatgggggcagtggcaatattcgtccaaagtcgggatcatgatgctacggtcgtcctggtttcgctacgtcttacctagtgccaccgaacctcgccaacaagcgaaggttccgtgacatccgggactacaccagccgattgtggcaaccgtatgacatcattttgcccagcccctcagtcgccgggccattattgcggcggcatccgcaccgcgccgtccaggcggatggcgctgccgttgagcatgggattgtcgcagatggccaggaccatcttggcgaattcctcgggccgccccaggcgatgggggaacagggtcgaggccaccagattgtccatgacctcgtcgggcatgccggccagcatgggagtctccatatagcccggcgccaccgccatgactcggatgcccagcggggcgaattcgcgggcggcgggcagcgacagggcggcgaccccgcccttggacgaggcgtaggcgcactgccccacctgcccgtcccaggcggcgatggaggcggtgttgacgatcacgccgcgctcgccatccgccaggggctccagccccgccatgtcggcggcggccaggcgcatgacgttgaaggtgccgaccagattgacctgaatgactcgggcgaaggtctccagcggcatggggcccttgcgccccaccaccttgcccggcgtcaccacgccggcgcagctcaccgcgatgcgggccgggccgtgggcgtcgcgggcctgggccagggcggccagggtcgaagcctcgtcggtgacgtcgcaggcggcgaagactccgccgatttccttggccgtcgcctcggcggcggcggcattgatgtcgaacaccgcgaccttggcccccgccttggccagggcgcgcgccgtggcctgccccagtcccgagccgccgccggtgacgatggcggccaatccgttgacgttcattgtcgaactcccctcgcgattatcgttgtttcggggcttccgccccgcccccgattggaggagacctccaaaccaccctttgattcaaaaagggggtttggggcatcgccccaagccggttcgggcggcagccggattaaaaggtcaaatccccacagcccggcaccgcgtcgaaatgggccagcacctggccttccgtccccgccgggttccaggcgggcttgttgtcacggtcgatgagcagggcgcgcacgccttcgacgaagtcatgggcgggcgccagcgccatggccaggcggaactccatcttcatgcaatcgtcgaaggacagggtggcgccgcggcggatcatctcgaagctgaccgccaccagatggggcgacttggcgcggatggtggccagggtctcggcggcgaagggatcgctttcgccttcgagcgccgcaaagacctcggccagactggccttgccgaaacagcggtcgatcaactctcgccgggcgtcgatggccgccgggccggggtcggaagcaaagccgtccaggctggccttgacctcggcggcgtcgcgggcctcggacagcgcctcgatcagggcgggaagctgggcgctttccacgaaatgggtggcgacgccaacatgcagggtatcggccgccttcagccgcgctcccgtcaggccgagatacatgccgatggagcccggcagccggggcaggaagtacgatccgcccacatcggggaagaagccgatgccggtctcgggcatggcgaacagggtgcgctcggtggcgacccggtacaggccgtgcaccgacacccccacgccgccgcccatgacgatgccgtcgataagcgccacatagggcttggggctggtgtgaatgcggcggttgaggcggtattcgtcgcggtagaaggcggcggcgaattccaggtctccggccttgcaggcctcgtaaagctgcttgatgtcgccgccggcgcagaacgccttctcgcccgcgccctcgatggtgatgcaggccacgtcggcatcagccgcccactggtcgaggcggggatgcatggcgtgcacctgatccagcgtcagggcattcagcgccttgggccggtccagggtgatgcggcccagatggccggtgcggtcgaaatggatttcagcagacatcaaatactctccggcaaatacccattgtcatcccgaggaagcaacgcgaccgagggatctcagtctgtgacggcttgtccgaattggcaccgacgcgccggacgggagatccctcgcatgcgctcgggatgacacggcacctcacagattggccttccacatcgcggcatagctatcgcgcagcacgttcttttgcaccttgcccatagcgttgcgcggcagttcggtcaccaccaccgccagcttgggcaccttgtaattggcaaggcggcccttcagggagtcgataacgccctcggcggtcagggatgcccccttctcggccaccacgatggccagcccggcctcgccgaaatcggggtggggcatgccgaccacggcggattccaccacgccggccaggcggtcgatgaagtcctccacctccttggggtagacgttgtagccgccggaaatgatcaggtccttggcccggccgacgatggagacatagccccgcgcgtccaccacgcccacgtcgcccgacttgaagaagccgtcctcggtgaagtcggacttggtcttctcgggcatgttccagtagcccttgaagatgttgggtcccttgacctcgatgatgcccacctcgccctggggcagcacctgaccttcctcgccggtgatgcgaagctgaacgtcgggcaggggaaagcccaccgtccccgcccggcggtcgccaaccagcgggttggaggtgaacatgccgccctcggtcatgccgtagcgctccaggatggtgaagccggtcttgtccttgaaggcgttgaaggtctcttccagcagcggcgccgagcccgagatgaacagccgcatgtgggaacacgcctcgggcgtgagattggggctggtcaggaagcgggtgtagaaggtgggcacccccatgaacaccgtggcgcgtttcagcaagccgatggcctgctcggcgtcgaatttggggcagaagatcatggggctgccgttcagcagcacgcaattgatggccacgaacagcccgtgggtgtggaagatgggcaggcagtgcagcagcacgtcgtcgggccggaacccccacaggtcgtgcagggtctgagcgttggagccgagattggtgtggctcatcatggcgcccttgggccgcccggtggtgccggaggaatacaggatggccgccatgtcgtcgccgccgcgcggcacggtggcgaaggtctcggacaggcccttggcccgctcgggcagggtgccgtcgccgtggctccccagggtcatgacgcaggtcccgatgccggcggcgacggccagcccctccagctcggccaggcggctgggctggcacaccacggcggaaggcgccgcgtcgaacaggaagtattccagttcgcccgcctgataggcggtgttgagcggcagcagcaccgcgccggagcgcaggcaggcgagatagagcaccaccgcctcggccgacttgtccacctgcaccgccacccggtcgccgggcttgaccccggccgccaccagggcatgggcgtagcgggcgctcatggcctccatatcgccgtagctgacggtgatcccgccgggcacctcgatgaaagggcgggaccggtcggcgggaaagcgcgagcggaacagctcgaacaggttgtcggtcatctgggcgcgcccctttgtcatcaaagcctgattacggcgataccatatgggcatgccccgcgccaccattttgtatccaagaaatgcctttctcggatacaacactagctcatgatggacacgaattccgaaaagatgtcggcctggatggtgacatgcttgcgcatcaccgcctgggcgcggtcgggatcggccgattcgatggccgccaccacctcggcatgctcggccagcgagccgtcgatgcggccgggatggttgagctgataacggcgatagggggcgaggcgggcatagagggaccgcgccatctccttcaacacctcgttatggctgccgtcgtaaaccgcgtcgtggaaagcgcggttcagggcgtaatagccgtccaggtcgcgggcctcgcacagggttccggcctcggccaccatggcggaaagcctggacttttcctccggcgacatgcggcgcgcggcatagcgggcgcacagcccctcgatgtcgctcatcacctcgaacatctgcaccatgcggtgcagatccaggggcgccaccacggcgccttgacgcggcttcttcaccaccaggccggaatagaccagttgcaggatggcttcgcgcaccggagtgcgcgacaggccgaagcgggtggccaggctctcctcgtccaggcgggtgccggggcgcaaaagaccctggaagatctcccgttcgatcacctgacggatctcgtcggcccgggtcgccggctttttttgctcgttcatcgggcctccaaacccctgatgtggcggtgccgagtatacatctcccgccgacactgtctaagggcaatccgctcttcggacacaaaatctgtgtatcacgtatacaagagatggacccggcgcatcccttgtgataattccatacccatcggggccattgatgggtaccctcgtctgcaacaaccggggcgttagactccggatcagggatacgaagcgcatggatttcggactgaccccggaccaggaggcttttcgtcaggccgcccacgatttcgccgtgggcgagatggcgccccatgccgcccattgggacgaagagggcatcttccccgaggacacccttcgcaaggccgccgagctgggcttcgccggcatctatgtgggcgaggatgtgggcggctcggcgctgtcgcgtctcgacgccgccctgatcttcgaggaactggccgccgcctgcccgtccaccgccgcctatatctccatccacaacatggcggcgtggatgatcgacagctttggcgatcaggagcagcgccgccgcttcctgcccgacctgtgttccatgcgcaaattcgcctcctactgcctgaccgagcccaatgccgggtccgacgccgcgtccttgcgcaccaaggcggagcgcgacggcgatcattatgtgctgaacggcaccaaggccttcatctcgggcggcgggcgctcggacgtctatgtggtgatggtgcgcaccggcgcccccggccccaagggcatctcctgcctggtggtggaggccggcacccccggcctgtccttcggcaagcaggaaaagaagctgggctggaagacccagcccaccgccagcgtgatcttcgaggattgccgcgtgcccgtggccaaccgcatcggcgccgagggcgacggcttcaagatcgccatgaagggcctggacggcggccgcatcaatatcggcgcctgctcgctgggcggcgcccgggcctgcctggagcacgccatcgagtacaccggccagcgacaacaattcggccaggccatcagcgccttccaggccacccagttcaagctggccgacatggccaccgaactggaggcggcgcggctgatgatccatcgcgccgcccattcgctggattccaagtcgccccaggccacggtgcactgcgccatggccaagcgcatggccaccgatgtgggcttcgccgtcaccgacgcggcgctgcaactgcacggcggctacggctacatcaaggaataccccatcgagcgctatttccgggatctgcgggttcaccagatcctggaaggcagcaacgagatcatgcgggtgatcatcggccgggcgctgaccacctaacacactctattcagacagggaggcttcacatggcgagcatcgggttcatcggtctgggcaacatgggcgcgccgatgatgcgcaacctgatcaaggccgggcacaaggtggctgccttcgatctgtccgaagccgccctggccgccgccgccgaggccggcgccaccgcctgcaccaaggccaccgatgccgcccggggcgccgaggtggtggtctccatgctgccggcaggagcccatgtgaagtcggtgatgctgggcgaaggcggcctgttcgccgcagcaagcaagggcaccctcttcattgattcctcgaccatcgacgtggccaccgctcgactgttgtccgacgaggcttcccgggccggtcacgccctgatcgacgccccggtatccggcggcgtgggcggggccgaggccggaaccctgaccttcatggtgggcggcgccgacgattccttcgcccgcgccgagcccatcctggcggtgatgggcaagaccatcgtccatgccggcggccccggcaacggccaggcggccaagatctgcaacaacatgctgctgggcatctcgatgatcggcacctgcgaggccttcgccctggccgagaagctgggcctggacgcccagaagctgttcgacatctcgtccaagtcgtcgggtcagaactggtccatgaccagctattgcccggtgcccggcccggtgcccgcctcgccagccaaccgcgattacaaggcggggttcgccgccgccatgatgctgaaggacctgaagctggccgtggaggccgcgcagaccgccggcgcctccattccgctgggcgccgaagccgcccagctctacgccatgatggcgggaatgggccagggcggcctggatttctcgggaatcatccacatgctgcgcggcaaggcctgatgggagcgcccctccccccgtcatcccgagcgacgccgagggatctcgtcctggcatggcggctccgtcccggcaccatcgccccagacggagattcctcgcccgcggctcggaatgacagggacggaagggcggtcaatcaaggcttgcacggcaattaaaaaaacgtatgctcgttttcactgatgagaccctcgccaagaagggtccgggtacagggtggttcggaggccgcgccgcacaggcgcctcctccggttcgggagcgatagacgatgtccgtgacggataatccggttctggaagtacgcgacgtatcgctggcctttggcggcgtgcgcgcgctgaccgaggtcagtttccaggtcaacaagggagagctgttctccatcatcggccccaacggcgccggcaagacctccatgctcaactgcgtgtcgggccgctacaagccgacctcgggccgggtgttcatggatggccgcgacgtgacgggactgtcgcccaatgtgcgcgccacgctgggcctgggccgcaccttccagaatctggcgctgttcggccatatgagcgttctcgacaacatcatggttggccgccaccacctgctgggcaacaacgccgccaccggcgcgctgtactggctgagcggggcgcgcaaggaagagctggcccaccgccgcaaggtggaagacatcatcgacttcctggagatcgcccatatccgcaaggcggtggcgggcaccctgccctacggcctgcggaaacgggtggagctggcccgcgccatggccgtcgagcccaaggtcatcctgctggacgagcccatggccggcatgaacctcgaagagaaagaggacatggcccgctacatcgtcgacctcaacgaggaatggggcatgacggtgatcatgatcgagcacgacatgggcgtggtcatggacatttcccaccgggtcatggtgctggaattcggccgcaagatcgccgagggcctgcccgacgaggtgatgaacaacgaacgggtcaaggtcgcctatctgggcatcgacgaagacgaggacgtggcgtgatgagcgagtacctcgacacctccattcacgacacctttcccaaggccctggtgcacaacgcccagcgctggcccggcgaaatcgccatgcgggaaaaggaattcggcatctggaacgccttcacctggtccgactacctgaaccgggtcaaggacctggcgctgggcatgctggccctgggcgtaagccgcggcgacgtggtggccatcctgggcaagaaccgccctgaaagcctgtggggcgaggtggccgcccatgcggtgggcgccatgagtctcggcatctaccatgattccatgaacgccgaggtggcctacctgctgtcctataccggggcggcggtggtgctggccgaggacgaggagcaggtggacaagctgctggagatttccgcggaagtccccaccatccgccacattgtctatttcgatccgcgcggcatgcgcaagcaccaggacccgcgcctgatctcggccgaggagctgaaggccaaggcccagcagatcgcggcttccaatccgtcgcgcttcgacgaggaagtgggcaagggcaagggcgacgacgtggccattctgtgcaccacgtccggaaccacgtcgaaccccaagctggccatgctgcaggccgggccgttcctgcgccactccaccgcgtacctgcgcgccgaccccaaggcggcgggcgatgactatgtctcggtgctgccgctgccgtggatcatggagcagatctatgccgtggcccagccgctgatctgccgcaacatcgtcaacttcgtcgaggagcccgagacgatgatggccgatatgcgggaaatcggccccaatttcgtgctgctggcgccgcgcatgtgggaaggcatcgccgccgacgtgcgcgcccgcatgatggattccacccgcttcaagcaatggatgttcgatctgggcatgaagctgggcatgaaggcgctggacgccggcaagcgctccaagctggccgactggatcctgttcgacgcgctgaaggaccgcatcggcttctcgttcctgaagtcggcggccaccggcggcgcggcgctggggccggacaccttccgcttcttcctggccatgggcgtgccgctgcgccagatctacggccagaccgagctggccggcgcctataccgtgcaccgggaaggcgacatcgatttcgactcggtgggcattcccttcgacgacgcccagttgcgcatcgacaatcccgacgccaacggggtgggcgagatcgtggcgaccaccgacggcatgttcaccggctacttccgcaatccggaagcctccggcgccgacatcgtcgacggcaattggctgaagaccggcgatgccggctacatcaagcccgccaacggccatctggtggtgatcgaccgcatcaaggacctggccaccacgtcacacggcgtgcgcttctcgcctcagttcatcgagaacaagctgaagttctcgcccttcatcgccgaggcggtgatcctgggcgacaccaagccctatctctcggcgctgatctgcatccgtttttccatcgtgtccaaatgggcggaatccaaggggatctcgttcaccaactacaccaatctgtcggctcaaggacaggtctacgagctgctgcaggccgaggtggagaaggtcaattccacccttcccgagccccagcgcatccgcaagttcctgctgctctacaaggaactggacgccgatgacggcgagctgacccgtacccgcaaggtgcggcgcggcgtcatcaacgacaagtacggcgacatcatcgattccatgtacgccgaccgtgccatggtccccgtggacgcggtgatcaccttccaggacggcaccaccacacgggtcaagaccgagttgaaggtcgtcaccctgctgccgccccccgcccaacaactggccgcggaataggagaacacgacatgggttcctctctgcttctccaactcctggtcaacgggctgatcgtcggcacgctgtacggcgtggtcgccatgtgcttcgtgctgatctacaaatcgacccaggtggtgaacttcgcccagggcgagttcctgctgatcggcgcctggacctgctggtggctggtcaccagcatggccctgccgttctacgtcgccttccccatgaccttcctgttcatgatggtgttcggcatcgcgctgcagatgatcgtgctgcgcccgctgatcggcgagccggtgatttcggtgatcatggtcaccatcggcctgtccatcttcttccaggcggtgatgaagtccatcttcggcgtgtgggcccagcccttccccgagatcttcccggtcaagtcggtggacatcctgggcctgtcggtgcagcccgcctatctgatgagcctggtggtttccattgtcatcatgggcctgttcgcgtggttctttaagtactcgcgcatgggtctggccatgcgggccaccgccttcaaccagcaagtggcgcaaagcctgggcatctcggtcaaggcggtgttcgccaccgcctgggccatctcggccatggtctcggccctggccggcgtggtggtgggcatggtcaacggcgtgtcctcggccctgtcgttcttcggcatcaaggtcttcccggcggtgatcgtcggcggcctggattccatcatcggcgcggtgctgggcggcctgatcatcggcgtgctggagaatctggcggaatacgccgacggccagtacctgcacctgggcaatctctacaccgtggcgccgttctacgtcctggtcatcatcctgatgatcaagccctacggcctattcggcaccaagaccatcgagagggtgtgatgcgcaatagcctgtcactcaaaattcgtgcctgtcatcccgagggagccttggcgacagagggatctcagtctggcacgacatgtccgaatcggcgccatgagtccgggcggagatccctcgcttcgctcgggatgacggttcccggggagaatgacatgaaggggaaatggcaatgatttccagcagcctcattccctgcggccagttcaagaccacctacgcggccgacaccaccatgttcctgacgcccgcgtccaggaactggtgcatcgccggcatcctgctggccgccgcgtcgcccctggttctcagcaactacctgctggcgctgctgatccagatcggcttttacggcatcgccgccctgggcctgaacatcctggtgggctgcaccggccagatttcgctcggtcacgccgccttcttcggcttcggcgccttcgcctcggcctggctgaacaacacgttcggggtgccggtgctgctggccattccgctggccggcgtgatgaccaccctgctgggcctcttgttcggcattccggcggggcggctgaagggcctgtacctggccatcgccaccttcgcctcccagttcatcctggaagacttcttcgcgcgggccaactggttcaccggcgggtcctcgggcgccatggccaatcccatcagcctgttcggctatgaggtgggcggcgacaagggcttcttctacgtggttctggtcttcgtggtggtgatgtacgtgctgggcaccaacctgctgcgcacccgcgacggccgggccttcgtggcggtgcgcgaccactacctctcggccgaggtgatgggcatcaacctcaccaagtaccgcatcctgtccttcggcatctcgtcgttctatgccggggtgggcggcgcgctgtacggccactatctcggctatgtctcggccgagggtttcaccatcctgctgtccatccagttcctcggcatgatcatcatcggcggcatgggctcggtgatgggcaccctgatgggcaccgccttcatggtgctgctgcccgaagccaccgaggccgccgtcagcacggtcaagcacttcaccggcgacattccggccctgaccagcgccctggcctatatcaaggaggccaccatcggcctggccatcgtgctgttcctgatcttcgagcccgatgggctggttcaccgctggcgcctgatcaagtcttattggaagctgtatccgttctcgtactgaccaacaaaaccaagaacaagacgctgaactcgaaccaacgattcatgggaggaatcacacgatgaagcatactctgttcgccggaacggccgcgttggccctgttgtccgccggggccgccctggccgccgacggcatcctggtcggccacatcgccgacatcaccggagccacctcggcggtgggcaagccctatggccagggcatcgccgacgccatgaactacatcaacgcccatggcggcgtggccggcaagaagatcatcttcgagaccgtcgactacgcctatgaggtgccgcgcgccatggccgcctacaagaagctgaccggctcggagaaggccacggccatccagggctggggcaccggcgataccgaagcgctggtcagcagcgtggccaaggacgagatcccctatttctcggcgtcttattccggccacctgaccgacccgcagggcaagacctcggtcaagggcgcgccgtataacttcttctacggcccgtcgtattccgacgcctgccgcggcctggtccagtgggcgcacgaggactggaagaagaagggcggcaccggcaagccgaaattcgtccacatgggcgacaaccacccctatcccaacgcccccaagatggcctgcggcgcctatgccaaggagctgggcttcgaggtcggcaacgagatccagtactcgctgaagcccggcgacttcaaggcccagtgcctgtcgctcaaggaatccggcgcccattacgcctatctgggcaacacctcgggctcgaccatctcgctgctgaagtcgtgcgagaccgtgggcgtcaccacccagttcctggccaatatctggggcaccgacgagggctcgctcaaggccaccggcgacgccgccgacaagctggtctgggtggtgggcgcctccacctggagcgacgacacccccggcatgaagctggtgcgcgagatttccaaggtctcggacgccagcggcaatgaaccccgcccggtgcactacatccgtgccatctgctcggtctattacatgaaggaagccatggagatggcggcccaaagcggccccatcaccggccccgccatcaagaaggccatggaaacccatgccaaggactgggtcccggccgggcttgaaggcgtctgcctgccgtccacctggaccgccgacgaccatcgcggcaccaccacggtcaaggtctatcaggcctcgaccaagggcggcaccatcggcatgaagcaggtctataccgccgacattccgcgccgcaaggaatggctgggctggtaaatcgcttgaagcgggggcggtcacgccgccccccgtcattactctttacggaaaatggatacggccatgggtgaacccgctgtcaagcttgccccggaagaaatcctcctctcggtgaacaacatcgaggtggtctacgacgacgtcatcctggtgctgcgcggcgtcagcctggacgtgcccaagggcaagatcgttaccctgctgggccccaacggcgccggcaagtccaccacgctgaaagccatctcgggcctgctgggcaccgaggacggcgaggtgacccgcggcaacatcaccttcatgggcgaggagatcgccaaccgcgccccggaagacatcgtccggcgcggcatctttcaggtgatggagggccggcgcatcatcgaggacatgacggtcatcgagaatctgcgcctgggcgccttcacccgcaaggacggcggcgccgccgtgcgcgacgacatcgagaaggtcttccactacttcccccgcctgaaggagcgcaccggcctggccggctatctctcgggcggcgagcagcagatgctggccatcggccgcgccatgatggcccggcccaagatgatcctgctggacgagccctccatgggcctgtcgcccctgctggtgaaagaggtcttcgccatcatcgagacgctctgcgccgagaccggcatcaccatgttgctggtggagcagaacgcccgcatggcgctgaagatcgcccagttcggctacatcatggaatcgggcaagatcgtcctggacggggccaaggaagacctggtcaacaacgaagacgtcaaggaattctacctgggcggcgacaaggaacgaaagtcgttcaagaacctgaagtcctacaagcgccggaagcgctggctgtaggtcggaaggcctgccatcccgagcgcaagcgaggggtctccgctgggacggagctggccgatatccctccaccccgccaggacgagagccttcgcttcgctcaggatgacaagccggaatggaccgacacatgaccgaattttacgattccctggaaacccgctcgaccgacgagcgcgaggccgcgcagttcgaagccctgcccgagcagatcgccctggccaaggccgattccccggccttcgcccgcgtgctggccgaggtggacccggcctcggtcaccggccgcgccgccctggcccggctgcccgtcacccgcaagtccgagttgatcgacgcccagcaggccgatccgcccttcgcctcgttgattgccacgcccaagagcgagctgcgccgcgtcttcgcctcgcccggccccatctacgaccccgaaggctgggacaatgactggtggcgcatcgcccgggcgctgtatgccgccggcttccgccgcggcgacctgatgcacaattgcttctcgtaccacttcacgccgggcggcgtgatgttcgagaccggcgcccatgcgctcggctgcccggtgttcccggccggtatcggcaataccgaccagcaggccaaggcggtcgccgatctgaagccggccggctatggcggcacgccctcctttctcaagatcatcctggaacgcgccgaggagatgggtctcgaccactcgtcgctgaccaaggcctgtgtctccggcgaggcgctgctgccgccgctgcgccaatccctgaaggacctgggcgtcgacgtcacccagtgctacgccaccgccgatctcggcctgatcgcctacgagaccaaggcccgcgagggactgatcgtcgatgagggcgtcatcgtcgagatcgtccgccccggcaccggcgacccggtgcccgagggcgaggtcggtgaagtggtggtcaccagcttcaaccaggattacccgctgatccgcttcgccaccggcgacctgtcggccattctgaccggtcggtcgccctgcggccgcaccaatatgcgcctcaagggctggatgggccgcgccgaccagaccaccaagatcaagggcatgttcgtccacccccgccagatcgccgaagtggccaagcgccaccccgaggtgatccgcgcccgcctggtggtggaaaaggacggcgagaacgaccgcctgaccctcaacgtcgagaccagcgccaccggcctggaagcggcactgaaggattccttccagtcgctgtgcaagctgaagaccgaggtggccttcgtcacccccggcggcctgcccaacgacggcatcgtcatccaagacaagcgagcctgatcatgaccctgacgcctgaactcgatcccttcaagctggccaaggccctttcgggcaagcatctgatcggcggcaagctcgtgcccgccggctgcggcgaggtcttcgaggtggataatcccgccaccggcgagatcatcggcaccgccgccttcggcaccaaggaagacgtggacatcgccgtcatctcggccaaggccgcccagaaggactgggccaagcaatcggcccgggcgcgcggcaagctggtggccgaatgcggccgggtgctgtcggcccatgtggaggaactgggccgtctggtggccctggagaccggcaaggcgctgcgcaccgaaagccgggtcgaggccggcgttctggccgacatgttcaccttctttggcggcctgggcagcgaactgaagggcgagaccatccccttcaaccccgacatgctgaccgtcaccgtgcgcgagccggtgggcgtggtgggctgcatcattccctggaacgtgcccctgctgctgatggccatgaaggccgccgctgccctggtggccggcaattccgtggtggtgaagtcggcggaagaggcgccgctgaccgtgctgcgcgtcgccgagatcatgaacaccgtgctgccgcccggcctgttcaacatgctgtcgggcttcggccccgaatgcggcgcgccgctggtggaacaccccgatgtcaagaaggtgaccttcaccgggtccgtcgagaccggccgcatcgtctacaaggcggcggccgagaagctgatccccgtgacgctggaactgggcggcaagagcccgatgatcgtctgcgccgatgccgacatggatcaggcggtggccggggcgctggccggcatgcgcttcacccgccagggccagagctgcaccgcctcatcgcgcctgttcgtgcatgaaagcatccatgacgaattcgtcgccaaggtgaaggccaaggtcgacgccatggtcatgggcgacccgctcgacgagaagaccgatatcggcaccatcgtctccgacggccagttggagcgggtgaggagctacatcaagatcggcgaggagaccaagggcgccaccaagcatgtctgctcggccctgcccaccgatcccaagctggccaagggccgcttcgtccagccggtgatcttcaccggcatgaagaacagcgatcgcctgtgccaggaagagatcttcggccccgtctgcgccgtcatcaagtggagcgactacgaggacgtcctggcccaggccaacgattccgaatacggcctcgccgcctccatctggacgcgggacttcaagctggccatggacgccaccaagcgcctggaggccggcttcgtccaggtcaaccagaacctggtggtccagcccggcctgtcctatggcggcgtcaagacgtcgggcatcggcaaggaagcctcgctggaatccatgctggagcacttcacccacaagaagaccatcatcttcaacatgaagtgaggaaatcgcgttccttgagaagagcggcgcgcaagggagcaagatcgttggtggcaatccgccagaccagccggggattgatggtcccgtattcatgcacgatccgatcgcgcatggagcggacatcccgccacgggatatccgggcatcgatcctcgatgcccggagccagatgcttggccgcctcgccgatgatcatgatcaggtgggtgaccgccaggacggacttacggtcggcgacgaaggcgccttcctccaggccggagaggaagccttcgatctcggagatggaatccagaatgtccttcgcccgttgcagcgcccgctccacggcgtcagaagacatgggcagcctcttgcctcacccgctcatcgagcctgggcttgaggccgtcccaggtcagcatgtcgaccttgcaacccagccagtcggcggtgctgttctgcactccgcacagggtcagcaggctgaatttggactgggggtcgtagtcgatcaccaaatccacgtcgctgtccgggccggcatcgccccgggcgaccgagccgaacaccgccatgtggatcacgcccttggcgcgatagaacgcctcatgcgccctcaggatggcgatgacgtcttccagtttcgggacttgccccatggcgtttctccgtggccgtcccaaaattctaccaaaaacacccgtcttccacaaaggaccaagccatgaccaccgaccccatcgtcatcgtcggcgccgcccgtactcccatgggcggcttccagggagacttcgcctcgctggccgcgccgcagctgggtgccgccgccatccgggcggcggtcgagcgttcgggcctggcccccgatcaggtggacgaggtgttcatgggctgcgtcctgcccgccggcgtcggccaggcgcccgcccggcaagcctccctgggcgccgggctgccccgctccgccggctgcaccaccatttccaaggtctgcggctcgggcatgaaggccgccatgctggcccatgacctgctggtcgccggcaccgccaaggtgatggtggcgggcggcatggaaagcatgtccaacgcgccctatctgctggacaaggcgcggggcggctaccgcctgggccacggcaaggtgctggaccacatgttcctggacggactcgaggacgcctatgaccggggccgcctgatgggcaccttcgccgaggaatgcgccggcagctacaagttcacccgcgaggcccaggacggcttcgccctggcgtccttgagccgggccaagaaggccatcgccgacggcttgttcgccgccgagatcaccccggtggccgtggcgggccgcaagggcgagaccctgatcaccatcgacgagcagccgggcaaggctctgcccgacaagatcccgaccctgaagcccgccttcgccaaggacggcacggtgacggcggccaattcctcgtccatctcggacggcgccgccgccctggtgatgatgcgccgttccgaggccgagaagcgcggcctcaagcccttggccaccgtcctgggccataccaacttcgcccaggagcccgccctgttcaccaccgccccggtgggggccatcaagaccctgctggacaaggtgggctgcaaggccggcgacatcgatttgtgggagatcaacgaggccttcgccgtggtcaccatggcggccatgcacgacctcaagctcgagcacgagcgggtcaacgtccatggcggcgcctgcgcgctgggccatcccatcggcgcctcgggggcgcgcatcatcgtcaccctgctgtcggccctgaagacctacggcatgaagcgcggcgtcgccagcctgtgcatcggcggcggcgaggctaccgccttgatggtggagctgacctagcatgatcgccaccgaggaacagcagctgatccgcgacatggcgcggtccttcgcccgggagaagctggcccccaacgccgcccgttgggaccgcgagcacctgttccccaccgacgccatcgcggaaatgggggaactgggcttcctcggcatggtggtgccgtccgaatgggatggcgcggggaccgattacgtctcctacgccatggcggtgatggagatcgccgcgggctgcggcccgctgtccaccatcatgagcgtgcacaattcggtgggctgcatgcccatcctgacctatggcaccgaggcgcagaaggacgagttcctgcgccccatggcccggggcgagaagctgggctgcttctgcctgaccgagcccgaggccggctccgacgccgcctccatccgcacccgggcgcgccgcgacggcgaccattacgtcctgtcgggcgccaagcagttcatcagcacggccaagaacggccaggtggccatcgtcttcgccgtcaccgacccgcaggcgggcaagcgcggcatctcggccttcgtggtgcccaccgacacccctggctttaccgtggtgcgcgtcgaggacaagctgggccagcacctgtccgacacctgccagttggccttcgaggacatgcgcgtccccgcctcgcgccgcctgggcgaagagggcgacggcctgaagatcgccctggccaacctggagggcgggcgcctgggcatcgcggcgcaaagcgtcggcatggcgcgttcggccctggaccatgccctggcctacgccaaggagcgcaagcagttcggcaagcccatcttcgagcatcaggccgtggcctttcgtctggccgacatggccacccgcgtcgaggtggccgagcagatggtcctgcacgccgcaagcttgcgcgatgccggactgccttgcctcaaggaggcctccatggccaaactgttcgcatcggaaatggcggaacgagtgtgctcggacgccatccagattcacggcggctacggctatctggcggattttccggtggaacggatctaccgtgatgttagggtttgtcaaatctacgaaggaaccagcgacattcaacggctggtcatttcgcgggctttggcgacgcaataggggaacaggaccatgaaagacatcctcgtccacatcgacgacagcgaacgctgcaccgcccgtctggacatcgccatcgggctggccaagacccatggcgcccggctgaccggcctgttcgcccggaccgaaagccatcgccccagcgccgtcgcccacaaggccagcgaccaactgacccaggcccgcgacgccgccaaggaaaagttcaacgccgcctgcgccgccgccggcgtcaagtcccgctggtggcagttggcccatggcgagcccggccacgtggtcagcgagaccatgttctgcgcccgctatgccgatctggtggtgatgggccagaccgagcccaagagcaagatcgtgcccgaggaaatgatcgagcacgtcattctccactgcggccgcccggtgctggtcatcccccataccggcaacttccccaccgtgggtgagcgcatcgccctggcctggaatgccggcaaggaggcggtgcgcgccctcaacgacgccaagccgctgatgctgggtgccaaggcggtgaccgtgctcagcttgcgcggcccctcggacgacggctccagcgccatgggcgaggtgccccaggtggatatcctcgaccacctggccgcctgcggcatcaccgcccaggccgagcgtctggccggcgagcatatcggcaagatggacatgctgctgtcgcgcctgtgcgatctgggcgccgatctggtggtcatgggagcccacggccattacggcctgtccctgaagcgcggcaccggcacccgctacgtcctgggccacatgaccgtcccggtgctgatgagcaactgatgacgatgaccacagcctgtcattccaacgaccatcgggaggaggaatctccgcctggaacgccgattccgacatggcgccaccatgccaggacgagatccctcgcccgcgctcgggatgacaggacgtgacggcgctgacgcccaaggaccccgattaccgcgccaaggtggaggccagtttcgcccggcaggcgttcctggccaccatcggcgcgcacatgacggcgctggagccggggcgctgtaccctggaactgcccacccgggccgatctgtgccagcagcacggcttcgtccatgccggggccaccaccaccctggccgacaccgccgccggctatgccgccttttccctgatgcccgccgggtcggcggtgctgaccaccgagttcaaggtcaacctgctgagccccgccaagggcgacaagctggtggcccgcgccgaggtcttaaagcccggccgcaccctgatcgtggtgcgctcggacgtctatggcgtcgaaggcggcaaggagaccctggtggcgaccatgctggccaccatgatctgtctggcgggcgcctcggatccggcctgaggggcttgatccgtccttcctcgaagttcaaggctttcacccgggcatacaataggattactcttcctcaaagatgagggtgccctggggccgcccgctgtccgaggtggccggtccatggtgcttgagcgaattgcgagacttttccaggcggcccaactcctggccatatccctggctccaagtttcgccatctggtacctgacgacgttttcgtcgtctccgctgccgcggttcgaaagccacctgttccacgaattcgccatcaccatcgccacgctgatcggtgggttcgtgtcctatgtctcgtggcgcagctaccgggaatccggcgaagtcttcctgcgctggctgaccgtcggcttcctggccttcaccttgatctacgccccccatggcctcctgacccgcaccgcccatcacaatatctggctgttcctgctgttcggcccggtgtcgcgcctggtgatgctgagctgtatggcctatggcctggcccagtacggcaaggcggcggaagacgtcaaggcggtctcggccagcggcttctggcgcaaggtgctgatcgtgtgcggcgtggccgtggcggcggtggcgatcctggccaattcccccctggcgcccagcccctgggtgcgcatgcccatggagacggcggcggccctgctctgcctcggcggactggcggtcatggtccgccggcggatcacctcgcccctgatgaagtattacggcgtggccctgctgctgttcgcccaggcggccctgggcttcatgctggccaagccctgggaccacctgtggtggctggcccacgccatcttcgccgtcggcttttcggtggtcggatggggcgtgatcagcgccctgctcaccaccaaatccttcgcctcggccttcagccaggaacagctcatgcgagccctggagcaggaaaaggaactgctcgactccctcaatcgggagttatgggcggagcggcaattggcccgcaccaccttggacgcgctgcccgaccatgtctgcgtcatcgacgagagcggcaccattctggccgtcaacggaagctggcgggaattccatgaggccaataacggcgatctggccttttgcggcgtcggagccaattacctggaggtctgcgaacaggccgaaggagcccaaagcgagggagcccgggccgtcgccgcgggcatccgcgccgtgctggacggaagccaggacggcttctccatggaatatacctgcgacgccccgggcgaggcccggtggttcctgatgaatgtgcggcgcgctgaatcggcgggcggagtcagggtggtgatcgcccaccagaacatttcccagcgcaaggaggcggaactccgcctgcgccatctggccatgaacgatggcctgaccgggatcgccaaccgccgggccttcgacgaaaccctgggccaggaatggcggcgcgccagccgggcgggaacgccgctgtcgctgctgatgatcgatgtggaccacttcaaggcctataacgaccattatggccatcaggccggagacgaatgcctgaaggcggtggcggcgacactggcggcgaccgccaagcgcccggccgatctggtggcccgctatggcggcgaggaattcggggtcatcctgcccagcagcaccctggccgacgcccaggccctggccgagaagatgcgtctggctatcgcccggctcgagcttccgcacgaggcctcgcagaccgagaagaccgtgaccatctccatcggcgtttcctgtctgaatctggctgaaagccccggcgcgctgccacgcaacggcctcgacacccaaatcctgatcgcccatgccgacaacgccctgtaccgggccaagaccaccgggcgcaaccgcgtcacggcccaggccgccgcctgattctttccgcaacccttccaggtgatattccatgccccagcccgatcacgtggtccgcatcgacctgcccgaggcgaaagactatcccgaggacatcgccgcctatttcgccaaatgcgacgaaaagctgggcatgcggcccaacgtgctgctggcctacacggcgcggcccgagaagttccgcaccttctcgcgcttctacaaccagctgatgctggccgaggattccggcctgtccaagctggagcgcgagatgatcgccgtggtcgtgtcctcggccaaccgctgctactactgcctggtggcccatggccaggcgctgcgccagttgtcgggcgatccgcagctgggcgagatgctggtgatgaattaccgggtggccgaattgccgccgcgccagcgggccatgctggattacgcctggaaactgaccaagaccccccacgacatcgccgagaccgatcgcgccgccctgcgcgcggcggggttcagcgatgccgacatcttcgacatcaccgacacgacgggcttcttcaactacaccaaccgcatggcccacggactggacatgatgcccaatcctgaataccacgccatggatcgtcacgatttaaaccaaaaataggcactatcgcgggttgacgcccgcattggcactgccacactctgatacatcccgcgccgcgttaggcgaaataccagcctgggaggtcggcagtgcgcatattgtcccggtccatactggccttgctggccctgctggccgttcagttcgggccggcgcccgccctggcggccgattccgccccgcctccgcaggcggagcagagcgccgtccagccgcgcaccaatgccgagatccggcaatggtacaatgatcaggtggcggcgattcccgcgctggatgcccagtggcgccagcagggagtgagcgccgagaacagggcgcggcgcgcccatgccatccgccaccatgcccgcgtcaaggcccgcgagttcatgcccgacaaggccgaggtccagatgctgcgcgcccgcgaccagaagaaatacggcaatcccgacggccccggcttcgaggatctggtggcccgcaatcgcgagaaaggattgacgggcgacgcggtctacgacgacatcgtcggcagttccaaccgcacggaccgcgccaccaacgagaagttcggcgtcaccccgcaggccagggcaccatgacctctcagactccgttcctgcgtcccatccagtggctggcctccggcggggcggaatatccctatttcgccaccgtggacggccagcgctggcgggtccgggtcaacgacttcccggccgaggcgctttacacccttctggtggacgcccgggaggtggaggatttcgacgactggccgaccgcctgggtgcggccgggctgatgcgggctggacatgatggccgatcccgaataccacggaaggcaccacagagccgtcccgggggcaccatgatgttgcggatgatcgtcgtcaccttgtcgctgctgatcctggccccccaggtcatggccgagcaggttcgcctgaccttcctgcacgtcaacgacatctacgaataccggccggtggagggcaagggcggcctggccgagctgctgaccgtgctggagcgcgagcgcggccgcaatcccaatgcggtcttcaccttcggcggcgacctgctcagcccctcgctggcctccaacgccaccaagggcgcccatatggtggagttcttcaacgccctggcgcccactgccgccgtgcccggcaaccatgagttcgacttcggcaccgccaatttcgtcacgcagatcaaggcctcgacctttccctgggtgggctccaacatctccggcgtcgaaggggtcaagccctcgctgctgaccgagatcggcggcgtcaaggtgggctttgccggcgtgctgacccgccagaccacccgctcgtcccatgccgacggcgccaccttcgccgacgaggccgccaccctggacgccaccgcccgccagttgcgcgccgctggggcggaactggtggtggccctgacccatcaggatctggacgacgaccgcaagcaggccaatggggtcaagggcatcgacctgatgctgggcggccatgatcacgatcccatcagtttcctggagaacggcccgctggtgctgaaggccggtcacgacgcccattgggtcggcgtggtcgatctggtggtcgaccgccccgatcccggcaacagcggcccgaccacggtgcgcaccgccggctggcgcttcctgccggtggccgatgtcgcccccgctgccgccctggcgtcgctggtgtcccggacggattccctgatgggcgaagccctggaccagaagctggccagcctcgccacccccatggacagccgcaccaccacggtgcgtggtgaagaggcggccatcggcaatctggtggccgacggcctgcgcgcccatttcggcgccgacctggccctgatcaacggcggcggcctgcgcggcaaccgccagtaccagcccggcaccagcctgacccgccgcgacctgctgtccgagatgccgttcggcaacacggtgatgctgctggaggtcaccggcgcccaactgctggccgcgctggaattcagcctgtcggcggtggaatccaaggccggtcgcttcccccaggtctcgggcctgaccgtcgcctatgattccaccaagccggccggcaagcgcgtcgtcacggcccaggccggcggcaaggcggtcgaccccaagcgtacctaccggctggccaccatcgactatctggcggggggcggtgacggcttcgtcgccctgaaggacgccaaggtgctggtcaacgccgaggccgccccgctgctggtcaacgcggtcagcgactacatcgccgccaagggcaccgtttcccccaaggtcgagggccgggtgacggcggtgcggtaggacgccttcaccctattcgggagccgttccgctgaaaaagccgtaagcggtctccggcacgtcgctgcgcaatctctcgcgcccgtcgaccgtcacgaagaagcagccgtccatgctgcaataggcgatttccttcaccgcgccggaattggacttgcatgcggcaatggcgatggttccatcatgtccgcggctgccgaccgcggcggcaatgctttcatggtcgatcatgacggcatcccttttccaggcgaattcggggccacaaggagtacgccaccccggtgggatcttggggtgaaaaggctgtgacaatccggtgaccgacagcacggcttgtgcaccaatcgttctcactgtagtctccggccatgtccgcgccgtcccgcatcctgttgccccatgttccggtgctggtcgccgggattcggggcgcggtggcgctggagcccgacggcgagttccgccgcctgagccgatccgaggcggcgcgctatgcccgcaatgaaagcccgctggtctgtcacggcccggctgtggcggcgcggctggggctggacgatttcctgcgcctcgacattctcgaactcttcgccttcgtgcgcccggcccgcttttgcctgccgacgccgcgcgggctggccgatgccatgggcctgccccaccccgccgatctggaggacgaggccgaggcgctgatgaacgccgtgcgccgcctgctggaggaactgagcagccgcaccaatgccgacaccgccgccaaggccgtggacacccgcggtctcgcctggatgatggcccggggtggctggggctggggcaacgcggtgctggcggcgctgggcgtgcagggggattcaggacggggcggcggcgcgcttcgcgtctgggaccgcctgcccgaatggagcgaatacgcccccgagccgccccccggcaacattcccgtcgacccgaccgagacccgtcagcgcctagcccagatgctgggcgaaggggccgagcaacgccccacccaggccgattacgcctcggccgtcagccgcgcctttctgccgcgcgaagccgagggccaaccgcatctcgtcctggccgaggcgggcaccggcaccggcaagaccctgggctacatcgcccccgccgggctgtgggccgagaagaacggggcgccggtgtggatctccacccacacccgcaacctgcagcgccagctggacggggaactggaccggctgttccccaacgccggcgacaaggcgcgcaaggtggtgatccgcaaggggcgcgagaactacgcctgcctgctgaactacgaggagatggtcagccgcaatcgcaaccaggacgcccccgccgtgggcctgatggcccgctggctgctggccacccgcgatggcgacatggtggggggcgactttcccggctggctgaccgaagtgctgggccgcgcccgcaccttagggatcgccgaccggcggggcgagtgcatcttctcggcctgcccccattaccgcaaatgcttcatcgaacgcgccgtacgccgggcgcgccgtgccgacatcgtggtggccaaccacgctttggtgatgatccaggcggcgctgggcggcctcgacgacggcgcccagcccacccggctggtgttcgacgagggtcatcacgtcttcgacgccgccgacgcggccttttccgcccatctcaccggcctggaagccgccgaggtgcggcgctggattctggggccggagggcgaggcggtcagccgctcgcgcgcccgggggctgcaccgccgcgccgaggatctggtgggcggctcggaagaggccatcgccgccctggatggcgccctggccgccgcccgcgccctgcccggccccggttggatggtgcgcatcagcgagggcgagccccagggaccggccgaagcctttctgggcctgttgcgccggcaggtctatgcccgcgccgcccatcccgattccccctacagcctggagaccgagaccacggcgccgctggagggactgccggaggcggcgggcgccctggccgccgccctggggcgcatcgccctgccgctgcaggtgctgagcaagtcgctctccgccctactggacgacgaggccgccgagttggaaagcgccacccgttcccgcatcgaaggcatctgccgctccatcgagcgccgggtgctgatgcctttggcggggtggaaggggatgctggacggagtcgtccaggggggtggcgtggtcgagcgccaatatatcgactggttctcggtggaccggatcgacggccgcgactacgacgccggcatgcaccgccactggatcgacccgacgcgccccttcgccaaggcggtggtcgagcccgcccacggcgtggtcatcacctcggcgacccttaaggacgggtcgggcgacgtggagaccgactggcgggccgcagagcggcgcaccggcgcccttcatctggacagcgacccgctgcgcgccgaggtggcctcgcccttcgactacccgacccgcaccaaggtgctgatcgtcaccgatgtgcgcaaggacgacatggatcaggtgggggcggcctatcgggagctgttcctggcggcgaatggcggcgccctgggcctgttcaccgccatttcgcgcctcaaggccgtgcataagcgcatcagcgcccccctggaagatgccggcctgccgctgctggcccagcatctggacaacatggacacctcgaccctggtggatatcttccgcgccgaggagcattcgtgcctgctgggcaccgacgcggtccgggatggagtcgacgtgcccggccgctcgctgcacctgatcgtcttcgaccgggtgccctggccgcgcccagacatcctgcacaaggcccggcgcgccgagttcggcgggcgggcctatgacgacatgatcacccggctgcgcctgaagcaggccttcggccgtctggtccgccgcgccgacgaccggggcgtcttcgtcctgctggaccccatgatgccgtctcggctgttcggcgccttcccccccggcgtcgagccggtcaaggtcggactggccgaggcggtgcggcaatgccgccagctcctggccgccacggccgatgcataaaattttaaataaagttccggcactttttgccaaattcgtaagtactatttcgccacctcgataggataggtgtttatttttgatgtaaccttaggtatagttttctcgtgagcagagtctcaagaagtttgactctgcgtgttgccagaagaggcggcgatgacgctgctaacccaagactgccatttccgattggtctcggacacaggacaggaactgatcgacgccgatgattccgatgcgttgatctgcttcacacgtcagattctggcttgcccccgcttacgggactgcgagttcggagattactgcaccatccttgccgcctcgctgctgtcggaacacggccgcgccccgcacgagaccggccgaaccgccacaaccgttcaggcatctatgcgggagccctcattccaggaataggctatctcccgacttttgccatatgcccgttgacaagcatgcctaaagtcacatctgattgaggatgggatttgcctttggcatgtgcgttgggcgggggctggaatgatcgtttggcgtgacgccatgtcggtgggtgcaccggcactggatgccgaccacaagaggctgatcgacctgatcaacctgaccgaacagtggatcggccaggacaactggcgtcaggtcgccaccatcaccgaagaactgctccgctacgtcgacgagcatttccggcgcgaagaggcggtgatggccgccatcaaatactcagagttggaacagcacaagaaggcgcacgagaccctggcccacaaggccaagctgctgcacgacaaattcaaggccgccaccttggaggaggatctgaagacctgctcccaggtgctgatccgggtgctgaccgactggctggtcacccatatcctcaaggaggatatgaagtacaagggttccgtccccaagaaggccccgcccccgcccccggttgcgccggtggtcgagatgttcaacggcatgccgtccaaggaggacgaggccgagcgcaaggcccgctgggaagcccgccacaaggacatcgaatacgaactgccgcccaacctcgcccatctgctgaagcggctggactacgtggtgccggaactgcccccgccggccggcaagttcgagagcttcgagaagctgtgcgaggcggccatcggccggcgcattgacaaggtgctggtgttcttccaccgccacaacccggccttaaagcgcgagttgccacccttcttcctggcctcgcccgaattcgccgagaagttcaagctggcggtgaccaggttcatcttccccaccatctgggaaagccgcaacatccgcatgctggccaccagctacgaatgggccgaggacgacaccgacagcttctgggaccacgtcaccaagccgctggaagacagcatcctccagggctggaacagcggctgggacgagttgaagctgctggaaaccaagaagcccgacggcacaagggtcttccaggtcaaggacaacaccaaggccctgcgcgagatgctggcgccctcctcgcccgaggcctacgacatccccaagatcggcaaccgcgagatcgagaccctgcgctcgctgctcgatccccggaacgactggtggaagcgcctcaaccatgcatggcgcatctgccacgacctctacgagcaggaaaaggacccgcgcatctttcagcagaaggcccgcgacggcgcgctgcgcgacaatctgctgggcgccttcgccaagttcccgccggaatggggcgacttcctggtgctggcctgccaccgggtgttcccacgcatctcatcggccttcctggaaagcttcgtcagtaatttcggcaccaccgaggcccagcgggaatcccatgtgccctatacggtccgctatctgcgccaggtgaaggaagaccccgacatctggctgcgcgaacgcaatgccgagcaggaatggcaggcccagatgagggaattgtccaactacctcgccaaccgcgaggcggacgaggtggaaaaaagacgctgaggcgccatgcgccccgccacgattgacgcgcccccctgccggggactagctttccgctcttcatctgttgaatggaaagcatagacccatgtcctccgattcccgcgaccttgcccgctccgccaccgcctggccatttcaagaggcccgtgctctgctggatgagcgtctgaaaggcaaagcgccggacaagggctatgtgctgttcgagaccggctatggcccgtcgggcctgccccacatcggcaccttcggcgaagtggcgcgcaccaccatggtgcgccgcgccttctcgctgctggcgcctgagattcccacccgtctgttcgccttctccgacgacatggacgggctgcgcaaggtgcccgacaacatccccaacaaggagatggtggcgaagcatctgggcaagccgctgacccgcattcccgatcccttcggcacccacgaaagcttcgggcatcacaacaatgcccgcctgcgcagcttcctcgacaccttcggcttcgaatacgagttccagtcggccaccgactggtacacctcgggccgcttcgacgccgccctgctgggtgtgctccggcactatgacgacgtcatcaacgtggtgctgccgaccctgggcgacgagcgccgcgccacctattcccccttcctgcccgtctgcccggaaaccggcatcgtgctgcaggtcccggtggtggagcgcaacgtggatgccggcaccatcgtctacaagcgcgaggacggcaagctgatcgagaccccggtcaccggcggcgcctgcaagctgcagtggaaggccgattggggcatgcgctgggtggccctgggcgtcgattacgagatgagcggcaaggacctgatcccctcggtccagctgtcgacccgcatcgccgccatcctgggcggccgcgcccccatgaacctgacctacgagctgttcctggacgaccagggccagaagatctccaagtccaagggcaacggcctggccgtggaggactggctgaaatacgcgccgcaggaaagcctggcgctgttcatgtaccagaagcccaagaccgccaagcgcctgtatttcgacgtcatcccgcgggccgtggacgagtatctggcctatctgggcaagttcccctcggaagagccgggcaagaagctggacaatccggtgtggcacatccacggcggcaagccgccggccgaggacgcccatctgtcgttcaacatcctgctgaatctggtcagcgtctgccactcggacgatccggcggtgatctggggcttcatcaagcgctacgccccgggcgcggcgccggaaaccgcgccgatcctgagcgggctggtgggctatgccatcgcctattaccgcgacttcgtcctgcccaacaagacctaccgcaaggccacgcccgacgaggtcgaggccttcgccgcgctgaaagccggtctggaggccctgtccgccgaggccagtgtcgaggacatccagaatctggtctatgagatcggcaagcgcccctgcttcgccgacctcaaggcctggttcaaggcctgctacgaggtgctgctgggcaacgaccagggcccgcgcatgggcagcttcatcaagctgttcggcgtggccgaaaccatcgccctgctggacaaggcgattgccggccaggacatgtaaatcaacgcccctattccatccggggccgatatgccccggcccccttttacttacaaatgaaagggaggcttggaggcatcgcctccaggcggggccggggcggcagccccgcaatggatcaggggtcccggtgcagggccagccacacggtgggctggtccggcgccgtccactccacccgatggcggcaatgggcgggcagcagcagccagtcgccgggggtcagggcgcggggatgttcctccccctccaggcggaccatggcggcgcccctgaccaccaccacccactcgtcgtcgtcctgatcgagccactggccctcgggcgtggtctggccgttggagacgatgcgcagcaggcggaaccgcccgccgtccagcaagggatcaaaccgctccgcctcgaagtcgtcgttcggcagattgtcgaacaggcttccggcggcgggcggctggttcatccctcgctctccgtcttcttcttgccgccgatccggggttcctcgccccggatcaggcggatgatgttggccttgtggcggtaaaagcccatcaccgccagcccggcggccatcagggcgtattgcggcccggcgaaatacagggcgaagccgggcgaggccgccagggcgatcagtgccgacagggacgagatgcggaagatggccgcgctcaccagccaggtgccgatgcaggccagccccaccggccacgccgccgccagcaaggtgccgatggtggtggcgacgcccttgccgcccttgaagcccagccagaccgggaaattgtgcccaagcacggcggcgaagccggcaaccggcaccatctcacggcccagcaggacccacaccagccccacggcgatggcgcccttgccgccgtccagcagcagggtggccagggccagccccttgcgcccggtgcgcagcacgttggtggcgccgatattgcccgagccgatctggcggatgtcccccagcccggcgaggcgggtcagcaccagcccgaagggcaccgagcccagcagatagccgcccaaggtagctgcgaccagctcaagcatcgtgcgtatacaccgtccgcccgtcgacgatggtgcgcatcaccatgccctgcaccgggcggtcgtcgaagggggagttcttggacttggaatggaagctcttggcgttgaccttccagccgcgatcgggatcaaacagcaccaggtcggccgccgcccccaccttcaggcggccggccgccagattgaggatggcggagggagcacaggtgatcagcctcagcgcctcgatcaggctcatatggccgttatgggcgaggtccagggtgaccggcagcagggtctcgagacccacgccgccgaactcggccacggcgaagggcacccgcttggaatcctggtcctggggggaatggtccgaggccacggcgtcgatggtgccgtccttcagcccctcgaccaccgcctggcgatcggtttcggagcggagcggcggcgacagcttggcgaaggtgcgatagtccttcaccgccagttcgttcagggcgaaatagggcggcgcggtatcgcaggtgaccggcaggcccttggccttggccttgcggatgatctcgacgccggcggcagtggccacatgggcggcgtggtagcgcccattggtgatctccaccagccgcatgtcgcgttccagcatgatggcctcggcggccaccggaatgccggacaggcccatgcgggtggccagttcgccctcgttcatcatgccgccctcggccagggagggctcctccgggtgctggacgatcagcaggccgaaggtggcggcataggtcagcgcccggcgcatgacctgggcgttgcggatggccttgaggccatcggtgaagcccagggcgccggcctcggccagcatgcccatctcggccagttccttgccctccacccgcttggtggcggcggcatagggatagaccttggccagaccgatcttgcgggcgcggcgcgccacgaattccacggtggcgacctcgtcgatcaccggattggtgttgggcaggcagaccatggaggtgacgccgccggccactgccgcctcacccgccgatttcagggtctccttgtgctcctcgcccggctcgcgcagctggacgcgcatgtccaccagaccgggggcaaggcacaggcccttgcagtccaccacctccatgcccgagggcacgccgccctggaacaggccggggcccacatcggcgatggtctcgccattggtcagcagggcgccccgggtatccagcccggtggccgggtccagcaggcgggcgttgacataggccaccaggcccgaggaattgcgggcggccatcagacggctccttccgagcgggtcaggtcgcgggtcagcatgtccaggcaggccatgcgcaccgccacgcccatctccacctgcgaacggatcagcgagcgttccacgtcgtcggccacgtcggaatcgatctcgacgccgcggttcatgggaccgggatgcatgatcaccgcatcgggcttggcgatgcccagcttctcgcggtccaggccgaagaagtggaagtactcgcggatgctggggatgaaattgccgctcatgcgctcgttctggatgcgcagcatcatgatgacgtccacgtcggccagacccttgcgcatgtcgtggaagacctcgacgcccatgcggtcgaggcccgagggcaacagggtgcgcgggccgatcaggcgcacatgggcgcccatggcgttgagcaggtagatgttggagcgggccacgcgggaatggcgcacgtcgccgcagatggcgacgttgaggcccgacagtttgcccttgcggcgccggatggtcagggcgtcgagcaaggcctgggtggggtgctcgtggctgccgtcgccgccgttgatcacggcgcaattaaccttttcgctcagcagcttgaccgcgcccgaatccgggtggcgcaccaccagcacgtccagatgcatggcgttgagcgtcatggcggtgtcgatcagggtctcgcccttctgcaccgacgagcccgccgactgcatgttgatcacatcggcgcccagacgcttgcccgccagctcgaagctggtgcgcgtgcgcgtcgagttctcgtagaacaggttgatgaccgtgcggccgcgcaggagattcttgcgcttgtcgctggaacgattctgttcgacatagccttcggccaggtcgagcaggctggtgatctcgctcggggccaggccctggatgccgaggagatgacggtgcggaaaggcggcgtctgtcatggttcgggaactatagggccagccggcccgccgggcaagacggcgagagcgctccttgcgccgcaacgatacacgtgtcttgcgcccgggtcgaaagtacacccacaatgcggcaacgaaacccgccgaaaactgggtcgatgaaaacaggagagggacgcctggggctccgtgtccgtatcgccgtggcgatcgcggtcacctgccttgtctcggtggtcgtcgtggtgggctttcttcgccacgccctggaacgccaggcggcggcccagtggagccgcgagcgcggccaggtcgcctcggccctggccatcgggctcgacgccgccatcaagtccatgaccgaggacctccgctttgccgcctccctgcccgaaatggccgcattgcccgccatcaatcaggtggagcgcgccatcaacggcattcccgccgatgccgacccgcaaaagcggcagatcctgaacagcctgatgaagggcggacacttctctgtcctgttcgtgctgcagcccaacggcgaccactacatcagccaccccttccacgtgcaacagcgcctgaagcgcttcaatctggccgaccgcccgtatttccaggaagcctcccgcaccagcggccccgccctgtccgacgccttcgtgggggccgacggcattcccgccgtggccatcgacgtgccgcgcctcgacgggcggggggaggtcatcctgcatctgggcggcgtcatccatctgccccggctgacggaaatcttcgccggctccatcctgccgcccttcgatatgggcgtcctgatggaccgccagggcacggtgatcgccgccaccgggcgcggccagacggtggaggcccccgacggggcgctgaccgccgccgccagggcgttccagagcacctcccccgctcccggcaaggcagcggtcaaagcctatcccagccccaccggcaaggaggagatgatcgccgccttcgtgctgctgaacaacggctggaccgtgtccctggcccgcccccggtccagcttcgtcgacgagatcgccccggaggtgacccgcatctcggtcattgtcggcggcttgctgctgctggtgtcctccctgggtttcgcgatcgcccatcatgtggccgggcgctgggacgcggcgcgcaaggccctggccgccgcccatgacgagcttgagacccgggtgcatgagcggaccgccgccctggacaccagccgccgcgagctgtccaccaagtcgcgaacgctggaaaccattctggacaacatcgcccagggcatcagcgtctatgacgacgatctgcgcctggtggcctgcaatcaccggttcggagagttgctgcgcctgcccccggacatgacccggccgggaacggcgctggaggactacctgcgcttcaacgcgaggcggggcgaatacggtcccggcgaccccgaggcccatgtggccgagcgcatggatctggcccgcaacttccagccgcaccgcttccagcgccagagggccgacggcaccgcgctcgaggtcatcggcaaccccttgcccggcggcggcttcgtcgccacccacaccgacatcaccgaggcccggcgggccgaggaagccctgcgcaccctgtcgcgggccgtggagcaaagtccggtctcggtgatcatcaccgacccccgcggcaacatcgattacgtgaaccccaaattcatggaggtctgcggctacactttggaagaagtgcgcggcctcaatcctcgcttgctgaaatccggcctgacccaggatgcggtctacgccgacctatggcggaccattaccgccggcggcacctgggaaggcgagttgcagaaccgccggaagaacggcgaactgtattgggagagggcctccatctccccgatccgctctcccgacggcgccatcttgcactatctggcggtcaaggaggacatcaccgcccgcaaggccgccgaggacgccctggtcgccgccatgcaggccgccgaggacgccaaccgcgccaagaccgtcttcctgtcgcatatgagccacgagttgcgcacgccgctgaccgccgtgctgggctataccgagatgctggaaagcggcatggccgggccgctgccgtcccagcacgccgatttcgtcgccgccatttcggacagcggccggcacctgctgtccatcatcgacgaagtgctcgacatcagccgcatcgaactgggcagctaccgcatcgcgaccggccccaccgatttgaggtccatcgcccaggaatgcgtcgggatgctgcggccgcaatgcgtcgccaaggacatccagctcgatctggaggagggcggggccatgccgctggtcaccgattcccgcgccgtgcgccaggtgttgatcaacctgctgggcaatgccgtcaagtacaccgaggcgggcggccgcatctcggtcggcctgacgcgggccggccagaccctgcgcgtcgtcgtcgccgataccggctgcggcatcgccaccgacaagctggctcatgtcttcgagcccttccagcgggtggacccgctgcgcgccgacccggcccgcggcgtcggcctggggctggccatctgccgccgcatcgtcgagctgctgcacggcgacatcgctatccagtcggaaccgggccgaggcactgccgtcaccttgactctgccgctctccgccgcggacaactctcccattccatagggtctggacccgatccccgtcgtgacacttcgtcattttccggttagatttgacgaaactgccagtcacctgagattcagatcgcatgtccctccctgctgaaattacggatttcctgggcattctggacgaaagcccggtcggggtttccgtgtcgcgtcgtcgcgacggcctggtgctgttcgtcaaccgccgcttctgccagatcaccggcatgacgcccgagcaatgcatcggccattcggcgcggcgccacttcgctgatgacgaccagcgcctggaagtggtgcggcagttgaaggaggccggcgagatcgccgacgccgacgtgaagttcttccgcgtcgacggctcgtccttctggtcggtgctgaccatccgctccgccaccctgaacggtgaggcggtcaatctcgcctggctctacgacgtcagcaagcgcaagcaggcggaacaggccattctcgacggcaagaccctgatccgggccatgctggattcctccaccgatggcatcgtcctggtcaatgccgagggcaccattctggccgtcaacgccgccgcctcggccattttcgagaagaacagcgacgaccttccgggcaaggccatctgggatcatcttcccgattccgtcgtagcccccatgcgccggggaattgaccgcgtgctggaccgccgcgagaccgtcgagagccaccacgccatcggcgccaagctgttcgacgtgcacatgcatctggtggcggattcggtgggacagcgcgaccgggtggcgattttctcccgcgacgtgacccaaagccaccagcgccgccagcagttgcgcaagctggaaacggcattggagcaggcgccggtttcggtaatgatcaccgattcccatggcgccatcgaatatgtcaaccgcgccttcgtcctggtctcgggctattccgaggacgaggtgctgggccgcaacccgcgcctgctgaaatcgggcgagacggtggcctccctttaccgcgacatgtggcattgcctggcgtccggcgccacctggcagggcgagctgtgcaaccgggccaaggacggcagcctgttctgggaatacgccaccatctctcccatccgcgacgatgatggcgtggtgacccacttcatggcggtcaaggagaacatcacccagcgcaaggagaccgagcagcaactggtccatcaggccacccacgacacgctgaccggactgcccaaccgcctgctgctggaagaccgcgtccaccacgccatcgaggtggccaagcgcgagggacggcgcatcggcctgatgttcctcgaccttgaccgtttcaagatcgtcaacgacagcctgggccacgtggccggcgacgaattgctgaaggtggtgtcggaccgcctgcgccataccctgcgccgctccgataccgtggcgcgcctgggcggcgacgaattcgtggtggtgctgacccattttcaaagcaccaccgaactggccgaggtggcggaaaagatctccgccgccctggacgagccggtggaactgtctggccacaaggtgcatgtgggcgccagtatcggcatcgccatctaccccgacgacggcgataatttcaatgccctgatgaaagacgccgacaccgccatgtaccgggccaagcaaaaggggcgcaacaccttctgcttctacgattccaacatgaacgacgaggccctggaccgcctcaagctggaggaggcgctgcgccgcgccctggtgcggggcgagttccagctgttctaccagccccaggtcgacctgcagaccggtcggacatcgggggtcgaggccctgatccgctggaacagccccgagcgcggccaggtctcgccggccctgttcatccccgtggccgaggaaagcaacctgatttccatgatcggctggtgggtactggaggaatcgtgccgccagatcgccgcctggcgcgaagccggactgaccggcatcaaggtggccgtcaatgtttccggccgccagttcctcaaccacgccctggtggagtgcatctccgacctgatggcccaatacgccgtcctgccttctcagctggaaatcgaactgacggaaagcaccgtcatggccgaacccgaccgggccatcgaacagctgacccggctgcgcgagatcggcatccaggtctcggtggacgacttcggcaccggctattccagcctgtcctacctgaagcggctgccgctcagcaccatcaaggtggaccgctccttcgtgcgcgacgtcaacaaccagagcgacaatgccgccatcgtctcggcaatcctgggtctggccgacgctctcgacatgtccatcgtcgccgagggcgtcgagaccgagggcgaggagcagcacctcaaggatgccgggtgcatcaaggtccagggcttccgttacgccaagcccatgcccgccgatcagctcgccgcctggatgctgcggcaaggtcgcggaatctgacctcttctactggtcttacccgatgacgcgccccacctagtgaggtagcattgtcacaacttgtttaatttgccggtgacccaacgcaaatgaattcgatgccgcccgtgcccgagactccgtccggcgcgcctcccaatggcgcgtcggccggtgacgcgcgggatcggcggcgcaagaagcgcggcaagggcctgacgttgagggtcaacatcctgggcgccttcgccgccctgctgaccgtcaccgtcatcaccctggtcgccttcgcctaccataagaactccgcctcggtcctggaattgatgggccgcttcgtggagcgggtgtcggcctcgggcatttccagctccatggccctgctcgacccggtggagaccagcgtccaggccacggcccgactggccgccatcgacgaggccaaggcccgcgacggctcgctcttcccctacatgaccagcattctggcgacccagccgcaattgcagagcatttatctggccttcgacgcggatgggcgcttcctccaggccttccccataccgccgggaaccaggaaattcggcgcccacgacacccagccgccggagaacgcccgcttcgcgctgcgggtggtcgatcgcaagggtggcaaatataccgacgtctggacctatgtcaccgcggccggggccgtggtgggggaggagacctccaacgagctgaactacgaccccaggccccgcccctggtacaaggacgccatcgccaccaagggcctgatctggagcgacctgctggtctataccagcaaccgtcagcccggcatcaccgccgcctatcccatcttcgccgccgacgggcgggtgatcggcgccgccgccgccaacgtcgccaccaagcagatgtccgacttcctggccagcctggatctgggcgggtcgggcatggccttcatcgtcgacgagaaggagcagctgatcgcccatcccgacgccgcccgcacggtgcgccaggacggactgaaatactccctggtcaaggccgaccagctgggcgagcaggtcatcgcagacgccttcgccgcctaccgctccgccaagacgcgcacggtcagcttcgattccggcggcaagcggcacctggggtcgttcaaccccttccccaccgatctgggcaagaactggctgatggtcatcatcgtgctggaagacgacttcgtcggcacactgaaggaaaacagccgcgacctggtggctgtgggcttcgccgtcatggtgatcggcctgctgctggtggccctgctgtccagttggatcacgcggccgctgaccctgctcatccacgagattcagaagatccagaaattcgacctggccggtcccatcgcgctgcacgccatcgtcgccgaggtcaacgaactcatccactcgatgaacatgatgaagcgggcgcttcggactttcggcatgttcgtgccccgcgatctggtgcgcgagctggtggccagcggccgggccatcgaactgggcggccaggaccggacgctgaccgtgatgttcaccgacgtggccgacttcaccggcctgtccgagcgcatggcggccggcgacctgctggtccacatctcgcgccatctggccgccatctcggaatgcgtggcggaagaagacggaaccgtcgacaaatacgtgggcgatgctgtgatggccttctggggcgccccggtctggcgcgacgaccacgccctgcgcggctgcatcgccgcattgaaggcccgggagacccaggcccggatgaacgccgagtgggccgcccagggcctgcccaccatgttcgtgcgcatcgggctgcatacggcgccggtgatcgtcggcaatatcggctcggcctggcgcatgagctataccgccatgggcgacggcgtcaacgtcgcctcgcggctggaaggcgtcaacaaggcctatggcacccagatctgcgtcagtcaggcggtgctggacgccgcagggccgggggtcctggcccggccgctggatctggtggcggtcaagggccgcaaggccggcgccctggtctatgaattgatggcgttgcgcgacggcgtccctgagcttgcccccacggcggagcaactggaaatctgccgcatgaccgaggaagccttcaccgcctatcaggaccggcgctggtccgattccatcgccgcctatgagcggctggccgctctcgccccctcggacaagctgcccgccatcttcatcgagcgctgccgccacttcctggccgagccgccgccccccgaatggatcggcgtctatgagatgaagaccaaataatcaactacagccacagcacatcacaaaacccaaaaaagcagccatttgccacacacaccacgaagacagcaacagttacgggtggtcgccgacagaatgaaggcacattcaaaacacatgaatgaaagtctttccccccatcaaaagcgggaaagtcttaaggacggagcccttatctgactatttacgacgcccctgacataagtcatacgtatatccacctccaagacagaactttccacccccacaatcgcggtctagccctagttgaattgctaggtcttgatatctggcttgattgccccaatcacaggcaactattctgcagcctacagaggttttgacactatacggtgcagaagtggacggttccagcgttgagagtaatctgactgagcgggaacgtgacgtcttacaacttattgcctcgggcaagagcagcaaagaaatagcccgccacctgggaatatccattggcggggtgaactttcatattctcaatgccatgaagaaaatgggtgccgcgacaagggcacacgccgttgcgcgcgcgattttccttggacttttgctaccagaggtcggacgcaactgatcgaccggcttatcttggatacaggggagcaaggacgtgccgaagcccatggacaccatggaacacgacaatgagggctgcgtcgacaggcaggtcctgttcgagggggcggtgctcgccgtcctggctcgcgtcgtggaaagcgggatgcgcaccgacctggccgcctccgaatacctgacccgatttcccatcggctcggacgagcaccacatcctggcggatatgatcatctgtgtctccgacggccttcgcctgatactgacggcggccgagagcgaggcaaacacccgcatcatcctcgatgacgtcaccagggcctggcgcgacaccccgtctcgccgccgcctgtcggtgagaagcggagcaacccgcattcaggcctgcatcggcaaccttcgccgggccatcgcagctatttcctgagcccggccatcacggcgaagctgacgttcttgtagcggcactccacctgctccagtcccgcccggcgcaaccagtccagttgcggcgccagcggcgtgcggcgatccagggtctggcgctcgatggcggcggcgatctcgtcaaccgggagtccggcccgctggatcgcctcgtgccagtggctccagtagcgagcctccatctccgccgtatccccggccacctgatcggcgttgaccaccgcgccgcccggccggacggcgcgggccatggcggcatagaccgcccgcttgccctcgtcctccaggtggtggatggacagcgccgacatcaccacgtcgtaagccccctcctcggccagatcgagatgattcatcacccggaactccacgggcaccggatgggcggcgaagcgctcgcgtgcgcgctccagcatgtcctcggccagatcggtcagcaccagccggacatcgggccggcgttcggccaccagggcggacagcagccccgtccccgcccccaggtcgaggatacgggcgcccggcggcgcgaactcggtcaccagatccagggcggcgccatagaaatcgtcgaagcaggggatcaactgtcgccgcaagccgtcataggagcgggcggcgcggttgaaggcggcttcgatggtcagcgtcatattaaccttccctgacataaggagctttccaagatcggggcatattggactatcatccctgaccgacgccagccgtggaaggatcgcccgtgagccaggaacacccctttgcccaatacgtccgcattctcggcaaggggccgcgcctgtcccgccccctgaccttcgaggaggcccgcgacgccttcgccatggtcctgggcggcaaggtggagccggtgcaactgggcgccttcctctgcctgctgcgggtcaagaccgagacgccggaagaggccgccggactggccgccgccatccgcgccaccatcactccgccccagggcgggcctcgggtggatctggactggtccagctatgccggcaagacccggcaattgccctattacctgctggccgccctggccctggccgggcacggcatccgggtgttcatgcacggctcggaaggccataccgccgggcgggtgtggacctcggaggcgctggccgccctgggcctggggcaaagcacctccatggccgaggccgcccagcggctggagcacggcaatttcgcctatatgacgctggaacatctgtcgccgcccctgcacgccatcatggagctgcgccacaagctgggcctgcgctcgccggttcataccgtggcgcggctggccaatcccttcggggccgcctgctccctgtccagcgtctcgcacccgccctacgccccggtgcaccaggaggcgctgcgcctgttgggcgaccagcgcatgtcggtgttcaagggcgagggcggcgaggccgagcgccggcccgaaaaggcctgcgaagtgctgtccctggtgaacggcgagccgctgtccgaggactggcccgccttggtcgacggcgcccgcccccatgaggagcatctggacctgtcgcgcctcaaagccctgtggagcggcgcggaaggcgacgaaatggccggcgccgccatcgccggcaccatggccatcgcgctgcgcgccatgggccgggccgagtccgtcgacgaggccgagggcatggcccaggtgatgtggcgcgagcgcgacaagaccaaggtcccgggggcggcgtgacctcccgtcccgccccccggctgctgatctcggccgcccataaatcctcgggcaagaccacggtgacggtgggtctggccgccgccctgaccgcgcgcggccttgccgtccagcctttcaagaaggggccggactacatcgacccgctgtggctgggcgccgccaccgggcgggcctgccgcaacctggatttccacacccagccgcccgccctgatccgccagaccttcgagcgggattcccggggcgccgacatcagcctgatcgagggcaacaagggcctctacgacggtgtcgacctagagggcgccaactcctcggccatgctggcccagtggctggacgcccccgtggtcctggtggtggattgccagggcatgacccgcggcgtggcgccgctgctgatcggctatcaggccttcgatcccaccttgcgcatcgccggcgtcatcctcaacaaggtcagcggcccccgccacgaaaagaagctgcgcgacgtggtggcccattacacccgcatccccgtgctgggcgccgtgcatcgcggcccggacatggaaatcatggaacggcatctggggctggtgcccgccaacgaggccgaggcggcggccgccgccatcgcccgcctcgccagagccgtggcctcccaggtggacctggacgccctgatcgccctggcccaggcggcctcaccggtggaggaggaaaagcaagccctcccggccctcccggccaccactctgcgcatcggcatcgcccgcgacgccgccttcggattttattaccgcgacgacctggaggccttcgcggcggcgggcgccgaactggtgcccttcgacgccacctccgacccgcatctgccgcccgggctggatgggctgttcatcggtggcggctttcccgaaacccagggcgaggcgctggaggccaatgcctccctgcgtgccgaaatccgggaaaagggtttggccggactacccatctacgccgaatgcggcgggctgatggttctgtcgcgcgccatcgtgtggaaaggccaaaggcgcgagatgatcgggctgatccccgccgacgcggtgatgcacaaggcgccccagggacgcggctatgtccgcctgcgcgagaccgacgccttcccctggccccggctggaggacggcccagccgtgctgcccgcccatgaattccaccattcccggctggagaacatggaggacaccccccgcttcgcctatcaggtcattcgcggcaccggcatcgccgagaagcaggacggcttgataatcgccaacaccctcgccacctatgcccatatgaggtcggtcggcgccaatccctgggcgccgcgcttcgtttcgttcgtgcgtgcggtgaaggcggggcagcattgatgttttttaataaggcgggcctttacccacccgccgggctgtggaacagtgcccggccatgattatcatcgacaatctcagccacacctatccgggcacgcgcaagatgccgccccggaccgccatctcggacctgacgctcgaggtcaaggacggcgagttcgccatcctgtccggccccaacggcagcggcaagtccaccttgttccgcatcctgtgcggcatgaccctgccgggcaagggcaaggtcgccgtgggcggcttcgacctgttctcccaccccgcccgggtgcgcgagatcatgggcgtggtgttccaaagccccgccgtggacaagcatctgtcggtgggcgagaacctgaagattcacgccgacctctatggcatcaagggcgcggatttcgcccgccgccgcgacgaagccttgggctggaccgatctcgacggccgccaggatcagaaggtcgacaccctgtcgggcgggctggcgcgtcaggtggaactggccaaggtgctgatgaccgaccccaaggtgctgctgctggacgagcccaccaccgggctggaccccatgagccgccgcaacttcctggccgccctgcacaagctgcagcgcgagcgcggcatgaccgtgctgatgaccagccacgtcttctccgaagccgacgacgtggaccgcgtcgccatcatgcgcgaaggcaagctgctggcctatgacacccccacggcgctgaaggccatgatcggcaccgagatggtggtggtccagtcccgcgacgccgaggccctggccgcgcgcctgcgcgccgagatggggctggccgtgcgctgcatcggcgacgaggtgcgcctggaggagaccgagaacggcgagagcctgccgctgctcgaacgcatcctggacaactaccgcgccgacatcgcctccatcgccatcaaacagccggggctggacgacgtcttcgtccacgtcaccagcaaggcggtccccgaccacgctttggccctggatttgcgaaaggccgcatcatgaccggcatggcccccgtcgcctactcgctggccaagcgcgagttcacccgcttcatccgccagccccagcgcgtggtcggcaccgtggcgcaaccgctgctgttctggctgttcctgggcgccggcttcggcggctcgttccgcccggccggcatggagaacgtcacctatctcgaatacttctatcccggcgtgatgctgatgatgatgctgttcgcatccatcttctcgtccatcaccatcatcgaggaccgcgacgcgggcttcctccagggcgtgctggtcgccccggtgtcgcgtctggccatcgtgctgggcaaggtgctgggcgccacctccatcgccatgatccagaccctgatcttcaccatcgccgcgcctttcctcggcctgcatctgggggcggggtccctggtgctgctgctgatgggctttctgctcaccggtatcggtttttcggcgctgggcttcctgctggcctgggggatgaagtccacctcggccttccacgccgtgatgatggtgttcctgatgcccttgtggatgctgtcgggcgccctgttccccatcggcaacgtgcccgcctggatgaaggcggtgatgctggccaatccggtcagccacgccctggtgatcatccgcgcccccttctatggcggccccgagcggctgttcaccgacacccactatctggtgtcgctggcggtgaccctggcctgggccgggatctgcctgggcctgtccatggcccgcgtcaatcgccgggaaaagggcgtctgagtccccccttcctccggtcgccgcccctatccttccgtggcgaggaaagtgtggggcggtaaggtgattaccctcttttcttattctgattctggtgcattctgcgcaccttcgagggggctcgatctttagggggatgggtatggctgggcggatgcgccttgggctgcaattcagcatcgtgctgatcatcgccttcgtggtggtctgcctgacggtgaccacggcgggcagcatctacttcgccagcaccaatgcggcgcgcgagggggcgcggcggctgttcggtgaaatcaccgccaaggtcgccgaccgggtcgaggggcagatcggcgacctgctggatctggccgggctgggcgccgcgcttcccgccatcggcacgcccatcgcgggtgacggcaccgatcatcccctggttcctttcatgctccgcctgctggagcagaattccagtctctacgccgcctatgtggggcagatggacggcgctttcttgcaggtgatcgcggcgcgcgacgaccgccgcatccgcgacgccatcggcatggcgccggccggcactcacttcatcatccggaccatcggcgggtccgcggaccaacgccgcgagtcctgggttttcctcgattccgccttcagccggctgggagcggcggacaagggggaggtcagctacgacccgcgcctgcgcccctggtacaaggcggcgctggtcggccagggcagcgtgctgtccgagccctatgtgttcaattccctgcaggccccgggcctgaccgcgtcccgccgcgcagcaagcgccgaagggacggtgttcggcgtcgacatcgcgctgaagggcctgtcggacttcgccgcccagcagaacgtgtccccgcgtggcggggtagtcctgcttgaccagaagcgccgcatcctggccatatcgccgcaattgctcagcggaacggacaaggagccgggtcccctggccgagttgtcgagcatggagacgccgctgctccggattctcggcgcatcgcggaccggcgaggcagacctggcctccaccgccgagggcgaggtcctcacccagatgaccgaatggcggcatgccagcggccaatccatcggcatcggactggccgcgccgttcgcggacttcaccggtcccatcgccgacatgcagtcgcgcatcctcaaggcggccgggctggtcctgctgctggtggtgccgctgtccaccctgttcgcccggcgcgtcgcccgctcggtgcgccatctggtggccgaggcctccagggtccgcgagttcgacttcaccggctcggcgccccgcgcctcgctgatttccgaattccacgacctgtccgaggccttcggcctgatgaagcagaccatccagggccgcaccaacgatctggccgccgcccagaaacggctggagcgggtggtcgacctcggcatcgccatgtcgtcggaacgcgaccacggcgtgctgatggaaatgatcctgatgggcgccaaggaactgaccaacgccgatggcggcacgctctacatccgcgacgacgacaacaatctgcggttccagatcatccgcaacgacacgctgaacatccgcatgggcggcgcccacgaggacccgccctcgctgcccccagtccccatgtacaaggatggccaggagaaccacaacaacgtggtcagccatgcggtgcacgcccagaccacggtcaacattcccgacgcctacgacgacaccagcttcgacttctcgggcaccaaggccttcgacgagcgcaccggctacaagtccatatcgttcatgaccgtgcccctgaagccccggggcggcgacatcatcggcgcggtgcagctcatcaactcgcgcccgccgggcggcaccgagatcgtccccttctcgcccgagatccagcgctttgtcgaggccctggccgcccaggccgccaccgcgctctacaaccgcgacctgctggaccagcaggagcggctgatggacgccatgatccagatcctggcgggcgccatcgacgccaagagcccctataccggcggccattgcgaacgcgtgcccgagctgtcgctgatgctggccgaggaggcctgcaaggtgacggagggctcgctggccgagttcgccttcaccacacccgacgagtggcgcgagttcaagatcggcgcctggctgcacgattgcggcaaggtcaccaccccggaatacgtggtcgacaaggccaccaagctggaaaccatccacaaccgcatccacgaggtccgcacccgcttcgaggtgctgctgcgcgacgagcgcatccgcatgctcgaagccgtggccgccggcaccccggcgcccgaggccgaagcggccttcgaggcggccaaggcggttctggccgatgatttcgccttcatcgccgagtgcaatctgggcggagagttcatggcgcccgacaaggtcgagcggctgaaagccatcgccacccgcacctggatgcgccatttcgacgaccggctgggcctggcccacgaggaactgcgccgctgcgagggcgagcctcagccgctgcccaccgtcgagaccctgctggccgacaagccccagcacgtcatcccccgcccgacggattcggcactgttcgaccccgcctatggcttcaagaccaagattccggagaatctctataatttcggcgaggtctacaacctgtcggtgggccgcggcaccctgtccgaggaagagcgcttcaagatcaacgagcacatcatccagaccatcatcatgctgaagcagatgcccttccccaagcacctgtcccgggtggtggaatatgccggcgcccatcacgaaacgctggtcgggaccggctatccccgcaagctggcggccgaggacctgtccattcccgcccgcatcaccgccatcgccgatattttcgaggccctgaccgcctcggaccgtccttacaagaagcccaagaccctgtcggaatgcgtgaagatcctcagcttcttcaagaaggacaagcacgtcgatcccgacctgttcgacctgttcctgacctcgggcgtctatcgccgctatgccgaacgcttcttgaagccggaacagatcgacgaggtcgacatctccgcctatgtgggctgagccgccggcagggtgaaatggaagactgagccctggtcgggcaccgactccacccagatccgcccgccatggcgttcgacgatcttcttgcagatggccagaccgatgcccgtgccggcgtaggcgtcgggggtatgcaggcgttggaagatgccgaagatgcgctcgaaatactggggatctataccgatcccgttatcggcgaccacgcactcccactcgccgccggtgcgctgccacgacaccttgaccagaggcgcgcggtccggcgcccggtacttgacggcattgccgatcaggttctggaacagccggatgacctggtccggatcgcccatcacccgaacggcctcgccgccttccgccacctcgacggcgccgccgctttcctcgatggccggtgccaagtggcgcaaggcctgatgcaacagcggatcggcgtccatggcgacgatgggcgagcccttgcgctggatgcgcgagaaatccagcagatccagcaccagccgatccatgcgctgggcgccgtcgcgggcaaaggccaggaattccaggccgtcgccttccagcttgggggcatagcgccgctccagcagggagagatagctggagatcatgcgcagcggctcgcgcagatcgtggctggccacgtaggcgaactgctccaactcggcattggagcgttccagctcggccaaataggtggccaccttctgctcggccagggtctgggcggtgatgtcgcgggaataaaccgccaccttgtcgggaacgccatccaccccggggacgggatagatggaattgtcgagatagagatcgccgcgccgatccaggtagtggatggcttcgccggtctgcaccacccgggtcaccgcctcctcgcgggccttggccacatccggcgggaacatgtcccacaggcagcttcctgtcagttcggtggcccggcgcccgaagcgcgccgccatcacctcgttgaccgccaacaaggtgccgtcgggccggaacagcatgatggcgtccgacgaggcgtccagcatggcctgaatcagggcttggttctcacggatatagagttcggtgcgcttgcgctcctcgatcaggcggacgacaccctcggtccccccccgccgcccctgggcgtcgagatagaagcgcgacgaggtggaggcccacaggatgcggccatccttgtggcgcagtcggagctcgtaatcgatgatcgaaccgccggcggcttcgagggcggccaccagttgggggcggctgtcatcactgccgtggaagaaggcggagtccagccccagcacctcctccaccgtgtagccgagcagaccctccaccgaacgcgacaccatcagcagccgcccctcggtgtcggtgcgatagaagatgtcgggcatgttgtcgagaatggcccgcagatcctcccgcgcctggacctgccgttcgacctgggtttccagagcctcggcctggcgtgagacctcctcgcccagtacggcggccaggcggtcggaatccaccagcatcaaggcgatgaggatcgccacatagcccagcccggccaacacgtagtaaagcgcgaaaccgccttccagggagacgaactcccggatcggccccagcatggccacccccagcccccgcccggcgagaaggcagccccagccgcccaggacggcggccagcagcaagagcccggcgcccggctcctcccggcggcggccaaggaccagctgcggccccgtgcagaaacaacggcacccggatcaacgaggcaacgacaatgcgaccgccaatgctgtcgtcggcataaagaaaatagctgaccccagccatgtaggcggccacaaaggccagatagaaggccggtcgcaccacccgccccgacaattgggcgcagcaggcgtgcagggtgaccgccgccaccgccagcagcagattgccgccgaaaatggccaccaccggcggcagggttccaatatgaatgatcagcagcaggccaaggccgtagctcggggccgacaggccgaagccaacccaccgccgaccgtggtggcgcgccaaaccataaccggcatagaccagaccgcaggccatggacgtcatggcggccgtgaatgccagtgtgccgacatcaagtcgaagcatcgcgcgggcttccccccatacctttcggttaggtgacgttcagattacggggtctggccccgtccgtccatagggaccatccccatggggtccttgacccatggggctgcttcaccatttgcaggaaagcacggaggtcctcatgcatcgttttctcccagccaatcccctcggctcgttcgtggccagcatggtcgccaccatcggtctggcgggcagcctggctgccgccacgcccaacgaccggctcgattgggcatcggttccgcttcccgccatcaatggcgggcaactgcccccggcctccctgaagggcaaggtcgtgctggtggtcaacactgcctcgcaatgcggcttcactccgcaataccaggggctggaggccctgtggcgccggtaccgcgagcgcgggctggtggtgctgggcgtgccgtccaacgatttcggcgctcaggagccgggcagcaataccgaggtcgccagcttctgcgagatcaattacggcgtcgacttccccctgctggaaaagcaggcggtgaccggcgcgggcgcccatcccttctaccgctgggcggcggaacggaccgggccgctgggcgttccgcgctggaatttccacaagatcctggtgggccgcgacggaggaatggtcgactggttcgccagcaccacggcgcccgacgccgaacgcctgcgcgccgccatcgacaaggcgctcagcccatgaagccgggcgtctcacgcaggctccaggtggcgggtcccttgccaggaaacaccgacttctccgcccggtaatagcggcgataggcctccaccggatcggggccatgataggcttccggcatggcctgtggcggttccgtccagccattgtcgggaatgggcggcaagggcggcaatccggcaatcacctcggccgaggcatgaacccggccccgccggtgagtatattcctcgcccagggccagccccaaggcccgcacccattgccaatgggccaggctgtcgccggtccacaacacgcacggatggcgggcatgggtggggcgatagggcgaggcgatgccgtagcggtgcagcacggcgcaaagaatctgcgccgtttccagcaccatcttcaccacatgctgatcggaatgcaggcgggcggcactgacgggatcgcgatcgagaaagaagacattcacggccgcatccctccccgcccggaaacgatatcaggccgcctgggcgaagatatcggggaagcgggcggcttcgatccattcgcggctgacggtgccgccgttgcggcccagcacggcgtaccagacgatgtcgtcggccacgcgaatgatctcgcaaagagccagcttcttctcgcccatggcgagggcatcctcgcagaccagactggtatgaacgaaacgaaggccaaatgacggtttcatcgtagactccatacacacgcgccatctttgatgacgcagtgcagcataacccggttttccttacggagtcatttacgcctggatgaaagctccaccctgaaagggcatggcgacctgccgccaacgcatggcttgcgggacttcagtcgcgaaagttgatgtactgcagcggctgatccacgtcgagcttgcgcagcagggcgatggcctcctgaaggtcgtcgcgcttcttgccggtgacacgcagttcgtcgccctggatggcgacctgcaccttcagcttggcgtccttgatctccttgaccagccgcttggccagaacggtttcgacgccgtccttgatgcggacctcctggcgcaccgtattgcccgacgccttttccaccgtcttgtaatccagcgccttggggtcgaccttgcgccgggtgaagtggacgctgagcagttcgtgcatggtcttgagcttggaatcatcgtcggccaggacggtgatcatctggtccttgcgctccaccgagcacttggagcccttgaaatcaaagcgctgggccacttcgcgggtaatgcccgccagggcgttgtcgacctcggcaagatcggtcttggaaaccacgtcgaaggagggcatgtctgggcctcggctcatttttcgggactggcgcgaggatacgcaggccttggcggtgtttcaacccgtcttggcctcgtcgtcttgcagcgcaccacaagaccctatagtctgaccggaaatttcgaagggggatgcaagatggcggattcccaggatatttcgctgaccgagttcgaggccctggtcgatcgcctgatcgacggcggctatcgcagcctgcccgaggccagcggcccgctggccgacaagctgaagacattggcggaaaagctggagaaccggtctcggtcgctgctgatccagtccgtgggcatgtccatccacctgaacggcacggtcacccaggcggtgcacaccttgcgctccatccgcgagatgagccggcgcatggccaccatctcggcctccaccgaggagctggtctccacggtccaggccatcgcgcggacctcggagctggccgcggccaacgcccgttcggtgcaggacgtctcggacgaaggggcgcgcagcaccgaagcggtggtcagcaccatgcagaacatcgtcaccaccgtgaacgacgccgccgagcgcgtatcgcgcctgaccgaggcctcgtcctccatcggcgccagcgtcaagcagatcgagcagatcgcccgccagaccaacatcctggcgctgaacgccaccatcgaggccgcccgcgccggcgagttcggcaagggcttcgccgtggtggccaccgaggtgaagaacctggccaatcaggtgggccaggccacccaggaaatccgctcgcgcatcgacatgctgacccaggaaaccgccgccatcctgaccggcatgggcaagggcgccgaaaccgtccgcgagggcgagcaggtggtgctgggctcggtggacaagatgcgcaccgtcagccacgagatccgcgacgtcaccaccctgatgcaggagatctccgagcatctggcccagcagcgccacgccgcgcaggaaatcgccgacaacctggaggccgccgccgcccgctcggtggacgacaccaaggccatcaacacggtgatcgacatctcgtccaaggccagcggcaatctggccgaaatgctgaacgagatgaatctggtggaaatgcgcaacgcggtcatccacctggccaagtcggatcacatgatctggcgccgccgcctggccgagatgctggccgaaaagaccaccatcaacccggacgagctggcgaaccacaagagctgccgcctgggcaagtggtactattcggtcaccgacgagaagatccggaaccacccggcgttccgcgccctggaagtcccgcacgagaaggtccaccaactgggcattgaggccgcacggaagttccgcgacaacgatttcgacggcgcggtggattcggtggcggccatcgaaggcccgtcccaggaggttcagaccctgctggacgagttggccaccgccttcagctgatcgtcgccggtcagggccgccggatgctgaccagggtcaggtcgtccggcggctcgcccggtaccttttcccggaaccgggccagcacctcgtcggccagggaatggccgggctgggcgcccagcacccactcccgcagcgtctcctggtcgcaggccatgcggccgtcgcttccctggctttccaccagggcgtcggaataggccagcaaggcggctccacgcggcaaagcgatgcggctttcctcgtattcggcatcgacgaaggcgccgagcggcggcccgtcggcatcgaggaagcggacctcgccgtccaccaccagcaccgccggcggcgaggccgcgccggcataggtcatgaccccttcttccacgtcgatcagcgcggcgaaggcggcggcgaactggccggagcgcagaaccgccttcagttccagattgagatattccaacagggccgatggcgtgggcatccgccgcggcaggcgcgacagcagaaggtgcaggcgaaagacgttgaacgccgccaccgggccgtgaccggtgaagtcggccaccagcaggaacatctggttgggaccggcgggcagcaccgtccagaaatccccccccagttcggaagagctttcgattcgcccatccaccaccagcccctgacggatgcgaatggacgacaattcggccgaggtgggcatcagggcagcctgggcgccgcgggcggcgcgcaactcctcgtgaaccctgtcctgatacgcggtcagccgatccatggcctggcccaggcgcagatgcacgcccacccgggcggcaacctcgttggcgtcgatgggcttggccaccatgtcgctgccgcccacggcgaagcaggcattgcggtcggcggggccgtcaagcgcggtgacgaagatcaccggcagctcggtcagggggtgaaggcggcgcaggcgccggcacatctcgaacccgtccatgccgggcatcatgacgtcgagcagcaccagatcgggcttttcccgctcgatggcggccaggcccttttcgccggattccacggtctccacctggccgactcccatgcggcgcagcagggtttccatcagcacccggttcatcaggttgtcgtccaccaccagcacccgcacatcgtccaggcccagcggctcggcccgcaactggcgggtgggaatgaccatggtggcgatggcccggcgccccccttcttcggtgtgcaggtccgaaaccatgctttccagcagggccagcccgtgcggccgtcggggattggcatggccgtccacgtgatcgaagccggggccgtcatcctcgacggcgacctccagacgatcgccaaccaccgaggcggaaatctgcacccgccgcccggcccggccgggatcgccaagagccgcctcgatccgctcgccgaagccttcgagcccaccgccgccctcgcagtcgatgccgcccacttccagattgccgtgcaacagggcattggagaccagctcctggacgacgaatcccagatcgaaactgtcggttccgggggcgagcagccgagtcgccagggcatcggcgaacgggacggcaatgtcggcgccataggcggtatccgagcgcagcgacaggcccagccctccttccgccagatggcggcggaagcacgaccccaccggatgcccgcccgagccggcggcctcgattcccccgatccagggcggagaaaggcaatcgatcagggcctggggcgtgaaggcctcgcgcaccatgaccgcgcgctcgtcgtttctgccgccctctcccggggccgccacccgaggccatcccagcaggcggatctgctcctccaaccgggggcaggccccctccatgacggcgacgatagtcattgttccttgctccggcgcaaatttaaggcaaatctaggttatgggaaggtctgcttggtccatgaaaacgacgggggcattatggagtacgatttcgattcccgcgatggtggtttgaccatcaaggtctctggccgcatgacccacaaggatcataaggcgttccgcgacattctcagccacatcaacaatgctggaacggccaaggtccgctttgacctctcccgggtggaattcatggattcctcggctctgggcatgctgctgatcgtccgcgacgccgcggttcagcagcgccgggacgtggtgctgaagggcgccaccgggcaggtggagaacctgatgaaggtcgccaagctgcacaagtatttcaccgtcgaatagcgtcatgagccgcatcatctatctgtgcccctttccgaagatggtcatcaccggaggggtgaagacggcgtatcgccacgtgggactgctgaccgagatgggattcgacgcctgggtgtggcagccggaaggatgtccatcctggttccggtctccgtctcgggtcatcacccaactttccgaggatgcgatccgcccggacgatattctggttttccccgaggtcatcggttttccggaattcgcgccgctgcttcgaacggcgcgcccttgcaccaagctgctgttctgccagaaccaatactacgtcttcaacgaaatgatccccaggacgacattcgccgctctgggcttccgggatgtgttcgcgtccagcctggcttgcaagggaatgctggagcgagtccttcatctcgattcggtggcggtcgtcccttacgacataaatcatgcacttttccgcccgcgcgagaagaagctgcaaattgccgtggttccccgcaagatgccgcaaatcgcctcgacgatcggcttcatcttcaaggccaaataccccgaaatccgccacatccccttcatcgtggccgataatttcaccgaggagcaattggccgaggccttgggaacctcccatatcctcctggccctgaaccagatggagagtctgggactggttcctctggaagccatggcgtcgggctgcgtcatcaccggctttcacggctatggcggcctggaatacgccaacccgcaaaccgggctctggcacgcccccgaccagttggaagaggtagccgattccctctaccgcctggtcaagggcttggaaagagacgagccctgggtggcctcgctccgaaaagaagggcatgaaacggccctgcgctataatgaggagaccacccgcaaggccctggtcgaatattacggccgcctgaacgtttcccccgcgggctgagccattttcccgagaatggcctcggcggcgatgcgcccggcgacgcgcatccgctcgatggattcggcgccattgcgcccgctcccctcgctcagcagctcggccggcatggcgatgctgcgcaggtccatggcccgcagccgctgcagatcacgcggcaggcgcatattggtccgccgcagacggttctggacgatctccagggcttccaggtcgcgcttcagcggagcgttgaacatcagccggcgcatgcgggcgaagatgggctgggcctgggtcggcatgatctcctcggtgtcgggcatcagcttgaccagcagaaccgtgtcgcaccggctgtcgaagatcatgggcatgatcggaggattggccgaaaaacccccgtcccagtagttctcgccctcgatctccacagcatggtgaagatagggcaggcaggacgaggccatcaggacatccacggaaagctcgttctcgcggaagatgcgcggctccccggtgcgcacgttggtggccgagaaatacaacccgatgcgccggcccctgcaggccaggacctcgaagtcaatcaaccgtcccagcaactcgcgcagcggattgatgttgagaggattgaactgatagggcgagagcatccgggtcatcagatccagttgcagattgatcccaggcgtccccatcatgcggaatagggccatgccggccacgctgcgccacagcgcctcgagcccggccttggctttctcccgcccgccggtcagcaggccggtgaccatgaccgcggcattgatcgccccggcgctggcgccgctgatggcggcgggccggaagcccttttcctccagcagccggtccagcacgccccaggtgaaggcgccataggcaccgccgccttgcagcgccaatcccaaatggggacggagcggcggcggcaggtcggaaatcacctcggatgggcgcacatccacgcgcaatcccccacaggctgcgccgcaggcgaagccgtgcggcgttgcaccgcatacgggaatatcccgttataggtaaggcggctcttggattatacagccccccgacctgcattcaagcaattgcatacacgcattgcctgaatacagtgccgccaacctgatcagtaggacttggcgaagatcacctcttgcgtcgccggacgtccgctcagcacgcaggtccccgcctcgccgtcctggtcgaagggcacgttgcggatggtgatgctgtattcgtccagcttggccagggtgtcggaatcgccgcaccaccgggcgcggacgaacttgcgcccgaaggtggtgtcgtcggcgaagacggccaggaagtcgtccagggtccgcaccgtcaccgtccgctccttcagggcggtggcggcctgggtaaacagggtcttctggatgtcctccaggatggcggcggcgcgggagaccagttcatccttgggggtgatctggcccttcagctcgccgtcgcggcggatcatggcgaccgagccgccggccacgtcgcgcggccccacttcgcagatgatgggagcgcccttcttcacccattcccaacgcttttccggcggcgccagcggacggcggtccacatgcacccgcagacgctcgccgccgaagctctgggcggacaggtccttgacgatgggggccaggaagtcctcgatcagcgcctcgtcgccgtcggcccgggtgatgggcacgaagacgatctgcttgggggcgatgcgcggcggcacccgcaggccgttgtcgtcggcatggctcatgatcacgccgccgatcaggcgggtggagacgccccacgaggtggtgtagcagaactcctcgccgccctgggcggtctggtagcggatgttctgggccttggagaaatgctggcccaggaagtgggatgtgccggcctgaagggccttgccgtcctgcatcatggcttcgatggaataggtcttgtcggcgccggggaagcgctcgtgggccggcttctcgccgacgatcaccggcatggccaggacctcctcggccatgacgcggtaaacttccagcatcttcaaggtttcgtccatggcctcctcggccgtggcgtgggcggtgtggccctcttgccagaggaattcggcggtgcgcaggaagatgcgcggccgcatttcccagcgcaccacgttggcccactggttcaccagcatgggcaggtcgcggtaggactgaatccagcgggcgaaggcgtcgccgatgatggtctccgaggtggggcgcaccaccagcggctcctccagcttgcccgacggcaccagcttgccgtcctcggccaccagccggtggtgggtgaccaccgccatctccttggcgaagccctccacatgggcggcttccttctccaggaaggacagcgggatgaacagcgggaaatagcagttctcgtgcccggtctccttgatgcggcggtcaaggtcgcgctggatggcctcccagatgccgtagccccagggcttgatcaccatgcagccgcgcacgggggaattctccgccatgtcggaggccttgatcacctgctggtaccattcggggaagttctcctcgcgggtgggagtgacagcggtcttcttggccttggacatgggattcatccaccggaaatgtgagcacgcatcccgatagcccatcccggccgctttttccagccggaagcggttccgcgctcctgcgtttcgtatcacgaaacagttatgtgacaaatcaggagattgttgatttataggctccgggactagagtcgtctccagcaaagcccatcaccgacgaggttccccgatgtccagtctctccctctcctctgccaagccgctgatccccgctgtcgcccccctcgcccaggcgctgtcgcccctggccgagcccatggtgcggattaccgccggtctgctgctggttccccacggtgcccagaagctgttcggctggttcggcggctatggcctccaggccaccggccagtttttcgccaccaagctgggcctgccggccggtctggcgctggtggccgggctgatcgagttcgcgggcggcctgatgctggccctgggcctgctcacccgcccggtggccgccctggtcgccggcatgatggcggtggcggtcttcggcgtccatctgggcaacggcttcttctggaccagcggcggcgtggaatacccgctgatgtggggcatcgtcgccctggccttcgtcatccggggcggcggccgcttctcggcggacgccctgatcggccgggaattctgatcgctttccagcctttcgcggcggcgcaaaatccctttgcgccgccgcaacgttggcgctataagaggcgcctcgcaggcgaccggagtgtagctcagcctggtagagcactgtcttcgggaggcaggggccggaggttcgaatcctctcactccgaccaaataaggccagtcaatccaacaggttggctggcctttaccttttcggggatcagcgtacatcccccataacatcccccgaaaagcccaagagaatgacgttggccgcagcccattgaccaggccgacatcaggcgggtatcgttgcctctggagcgtcagaactccgacgatgcataggcggggccgccccgataggcggcgcctccaaataccggacagggtaagggatgcgcgaaggcgcaggcccgtgcactggccagttgcgcgctatgccgggagggcggcggatacaacaccccgtgagggggaagaagcccgcacgacctatgccgtgttctgaacctcccggcgccagtgccgcccactggcgggccttcagaagcccttgcataggacacgacaccatgaccaccacccagatcggtcgagtatcggccgaaggcagcgatccccttgtatgcctggccaccgagtacatcgccgtcgccgcgatcattgacaacacgcccggaaacctcccagaccatcttggccgccggatcggcgaaatcctggagttggcccgcgcgacacaggccgagaccgtcgccgggatcgccgccaaactgcgcatccatctgaacgacagcctgacgcctgggggcacatggcccactgatggagccgttgatgaattactcgtcggggcactgcgtgatgctggccgactgagcggaacaagcttcggcatgtcgccagccgaacttgctggcaccatgggtccttccatccaacaggaggttcctatgccctacattgtcaaagcgccccacattttctcccctgctgtcggcattcccccgtatcagtcgcaacgggacgactcccaccgctctcctgcagaggtcttcatgcaagcaaggcggccgcgcgatacgatcccatttcaccttgacgcgactgcaatgcaaatcggtgaagtgaaccaggacgcagaactgctctcacgctgggatgcggcttgggctgccgaagacgaagcgaatgcgaccactagcgatgatccggcttttgataaggccatggagagatgggctgaagcatggcagatggtcgccaagctcccggccaagacgccagccggtttggccattaaggttcgggccatggcggatgatcttcgtaacgggcctaccgcgtaccacgaagacctgatccgcacgacactggaggcgttgtcgctgatcgaataggcagcgaaagcagaaagccggtggccaacatggaccaccggctttcaactggcttccatgcgctccaccaggaaaggcgagcaattcacggtcgtaggcgccagcggcttcccgacgctctcccatgaagggtggccgtcttcgggcttgctcggggagcagcatatcccccaacgcaagaaaactcaaaggcaggactacgttgtgaaatggcgaggccgcccccacttaacccgacgagctaaatcacgggacgccgcgaaacgcaatgtgcagcatcgcagccgatatcaacaagagaatgccaccatatgtaatggccagatacatattgtggtacatatagtgattaatggcaatctcaagcgtcacccccaaaggccacgccattatcagaagacatattagtcgcgcgacaacctttttccatgcaggcatatcaacccccactgacgcagtcgctaaattttttaccaactcgccgacaacttctcccttctgccccattcaaggtccacaaccacagacctaatcaatgcgggaagagcacgccgacgacccacctcccgatcactgttccacacttgatccgcaacgatcaatggcgggagccgctaccgccagtcggcacccccattgcctcattgataccctcctccgccgcatcaaacaggcggcggagatagaacaggttctggaacggcaccaggcgccggagtgccctcgtatcggacgagcgccactccccgcgcgaggcgtcccccagcacctggattgaggtatccaggccagcgcccaggccaggaccaagcaaggcttcggtggccgaacggctggcatagcggcttggtccctcgccatagccgaataccttggcgccgatgttgttgacatcggacagccagaacagcaggccggagcgatccacggcttccttggcccaaacggcgggatggtcggaaagatcgcgccccgaggctccgctgtacgcgacgtaagagagagcgccgagcccaagcgacaacagcgagccattcaacgccgccgcatcccgttgctgcaaggccgccagtgccacccgttgggttgaggcgatggagaatgtcttgaactgcccaatcatcttgcccagttcggtggacatccatagcggcttgtcctgccccggcttgatgatgatgcgatggacatccttgaccaaagcggcacgaagcgcgtccacggcttcacgatccacccaggcgctggtattggcccacatgacgccgccagactggcgctcgccatgccgggagaactggtccccgatccgcgccgccttatggtcgtcgataccgaggaaggccagatactctacctccttgggatcgtgcatgcccttggccatgccctccacagcctgaaggattcggctttgcgtgactaccgccgcaaattgctccatggcggtattccagggcgccatcaggctcaccatgccgaagcgatccgtaagggccttcacaccccgctcgaacttggacagccgcccataatcgtcccacacctcggcaagctgcatggcccggctatccagcaccatatccagcgcggcgcctgccaactgcgcttccttggccgccagccggaagcccctgaaattggagaccatgggaaccagaccatcgccagccactcgcatcatgccgtggaccatcaccgcccggccagcatcggccagcgatgccaccgtcatgccgcccatgaggcggagatagttccagttccgcaccaccttgccggtacgaacaatgaagcccgagggatcggcgggcagggcgtaggtgccacgaatgcgatcccgcaccgccgccacgtcgcgcagatcggcgcgcatgcgcttgtccaactgccccaaggtcgccggatctgcagagccaacacgaaggcgggcatagtcgctggcaatcttgtcgagttgatcttgcatgtccgcccggccaaacgccgtagccagttccacatccggggccatggtccgggaataaacccgaagcacagcttccacatcgctttccaggaagtcctcaatggcgtaatccgagatgcccagcgtccgttcccgtaacggccccctggtcaacggtaccggctcataggccgtccgagccggtgaagaaccgataacgtgatcggtgatttgcgtggcgacatccgccagctccacatcctccattccggcaaagaccttctcattctggaaggccgaagaaacccgctcatgctcggcccgcgcttgccgcagttcccgagccgcactctcacgcttcgccagcgcagcgctcatatccacccgcgcttgatcgcgtagcgtcttgcgcccgccgcgccgcatcttcgaggcccatgccagacttggcattgaccaaccgatgatcggccaagcccaaagctccggcctcacctccctgatccgccaagccgccattcttgcggacccaatcggacagggattgagggggcttcgggcgcccccttcatccagcgcggcccatcgccaagggtactgataccccaggttcgccgcacggcatccacatgactgacggcatcggccattccaagtcccttggaagcgccttcggcctgtcccttgctcatggcgctggccgcctgttgatcaacatcccgttcgatcagaccggatgcaaagcggcgcatcatctcccccaccgccgcaccggggccactctccattgccacgtcacccagggcaggactggccgtcgcctgcacgtctgaacggcgatagccagggaccgagatgccgcgcggattaccgtatggaaacatgtcagggcactcccacagacaggattgcgaaatggcgggattggattttcaggagcaggtcacagcggcgggcgtggatagcggcttgctgatcctgggatagctgaggctgccatatggccaaaagctcggcagcctcaccttcgaggcaaccacctgtcgcctgtgtcagccaagccgcaccttcaacagcatcggcttggcatccgcgcccaaggaggtacattgtcccaaggatagtcatcgccttgcggtttcccgccaaggctagccgtgaagctagtcggaacgcctcatcatcccggcggcccagcatcgcttgaccaagacggtaaagggctgaggtggcgagcattgcgaccgcgctcatgcctcgcctccccatcccatacccgcacccgattggcggacttgaagaagataggaagcgccccagaatttcggccgcatttttggccaccccagggggtggagggtggataccgaaaggggggggatacccccggccaacctcccagcggtcacccccagggaacacccctcccccctacctgcaccggccggggggaagcactcgcctcggcgacgacggaggcccccgcctcccctggccgggtcgccagcagcgcaggccaagcccacaccaccaaggccaaagagagtggctgacgacagccctggcatgaaagaagcaacaccggcggcctgagcgcgcggatgggccgccgctcggccccaggtgtagcgggcttcgcgcaccagatccagcgaggtgcgcaggtccagcgacggcgcggcctcatagcggcccgaacgccggatggacccgttcggcccatggaagttctgcgatgccttgacgtcacccggaaccgatggccctgcgggttgcgccagagacaggcatattgagagacgagagtgaagacggggaggcgctaagtgccgggtcggaagggtctcccgcgcgagatgttgcagtccctcgcggggatacgtccggggcaccttatgatcagcgctcccgaagccattccggcccggcgccgcccagaatagcgcaggttgccttgctggcaaagaacaccggcggcaggacaatatcctccggtattttaccgcatcggcggacctcagggcatttcgccctaatattttattgcccctcacagcttgatgccgtgacgaaggcatagcgccttgagctcggagacgaatgcgccgtaatcaaccgcctctaaagacatgttttggtggaaatagcgcagcctagcctttacgactgaatgcacggtcacgccatgcttcagtgcctccctttcaaacagggccatatcatcaaccccgatatatactctttggggcgtcccacccttgaccgatacgccatatgccttggcaggaaggacccgccccttcgtggccgcaagttggcgattggccagctcgattacggaaacgtcgtctcgcgctgccgtgcggcgtagggccgagacgatttcgggctccaaccaaacctggatcgtgccgccatcgaccttttgccccacccggtttgtgaggcggtttgtgtcgatactggcccatggtgttgatttcatttatatatcctccaatcaaacaacttaccaaaccaccaaaccaccaaaccgctacccccctatacgtgcgcgggtacgcacccgcgcgggcgcatgcgcacccgcacacatgtatgtcgttccccggtttggcggttttggcggtttggttgctcattgctcggtgccgatacgacgcattcctcagctttccgggaagcagccaaccaacccacgaaacaacccatccccccaaacccgcgctgcttttgattggacgcaaggggtcgggggcatcggatggggatgacggggatggattggaggggttgacctaccgacaccccgaaatccagctcgaaagacggggccgtgatcatgcctccgccctcacggtggcggcctgaatgtaggcatccagatcccgcaggaagtagtagacccgccctcgaactcggacatagcgaggccccgccttttgtaccgccaggttgcagagcgttcgggcattgaggccgagatatttggccgcgttctctcgatccatcctgccatcgggcagaaccacgacttggatggtttggactgccgatggggtcgggggcgcttggtggcggactgacgggctcattggttggcgctccgatccatgcggtcaacgccctgaagtaggcgttcaaaggctgcgaccggaaccagtagctttcgaccaatacggagggttggaatctccccccgctccgctgcgcgataagcgctgtttcggcacaagccgagaagctttccagcctccgggaccgacataaccttgcgcatatccatgacctgagccccaagatatagaaccagttttggttctattcccgcagcccagatcctgtcaacacccatatggaaccatatttggtttcagaaaccaattgcggtcctatttcgtcccatgttatgacaaggcgtcattgacggagaaacgcgaccatgccccgccaccgcaacgcagatgagagctcacaacttattattcggcagaataaaagatcaaaaaaggcggagaattctgagactggtgagccgaacttcaagcttcgcctcaaagaaccaattcgagacgccttggagaggagcgccaacaggcggggcatatccatgaattcagaggcatcagagcgcctcgaaagcgcattctttacagaggaagttattaatttcttttttcgtagcggaacatcaatagaggaagttcttatactcaggcgctatcttgtggcactgaagcaatccgttgagttggctggtgacattccagagcgatgctgggtttatgctccgtttgcgggtttcccgctcaatctcgatgcgctaggagagggctggcagcaaggcaacttggatgcagccgccttcgatatccccggaatggctttacgcattcggagcggagtcatttgcgcggccgctgacgacatagaacgcaatggcccccccattctggctggacgatctcaggagggggaggagcgcaaacaagccctgcgcctatggcagttcaagaaagcatgccgatttctcaaccttgctatcgagcaagatgctgctaccgaactacttccacggggcactgttatctacctagcagcaaaggaattggcttgcgatctagggcggggagaggcaccagaaattgaagcccttgcagccatgaaacttacctgacccgaaccgggttcgacctgggttggcggcccaatccgccctgcggcatatcgtggctgacccgcagcaatcgcccgcccgctccccgcgttaggaggagcccatcggggaaccagccccggccgaggcatatcatggcgttgaccctcgcgtactgcccgcctccccggcgtcacggggaagccaagggggtagtgtgcgaatgctcaagcgacgttcccgcccccagtcgaagtgacggagctggacgagatgagcaaccaggcgaacggcattcccacctcgggttcattaggaccggcgttggtcgggcggctttacacccttgatgaggcggccgcccagatccatgccagcgtgaaagccgcagccttgcgcgccgccatcgccgatggccgacttgctgcgaggaagatcgggcgaacgctactgatcgccggagaagacctcaacgcctacctggaggagtgccgcacatgtcccgcaccagccaaggccccaggctcagattattcggccccgatgatcggcacggcgccaagcctcgcaaggggttccgggaataccggtggtacgttctctggcaggaaggagggcaacggcgcgagcgtgcgacgggccttgaccaccgcgcaacggctgaagaaagggaagccgccctctccgccttcctcgacgaacaggaccggggccgacggccaagcggcccccgtcatcccgatcaaatgaccgtagccgaggccctgacactctatggggagaaccacgccccaaccacgtcatgcccggagcgcattggctataccatcgaggccctgacgccatggtggggggaggccaagatatcggccatcaccgccgccgcttgccgacgctacctcgcggatcgtaaagccgccatcgccaaggcccgagcggatcagcgcgcccttgtcgaagcgcggtaccgcgagcaagacaaagccccaccaccgccgctcaagcgcctggaagcgtccgacggaaccatccggcgcgagttgggcaccttgcgcgccgccgtcaactggtgccacctggagggctatttggtgcagccgccagcggtatggcttccagatcgcccccagtcaaaggaacggtggctgacccgccaggaggccgccaagctgatccgcgcagcccgcaagatcgaacgctccaacaagtacctccccctgttcatcctgatcgggctgtacaccggcgcccgcaaggaagcgatccttggcctacagtggcagcccaacaccgtcggcggccggattgatctggagcggggccttatcgactaccgcaagccgggccaggcgcagaccgccaagcggcggacagccattcccattccgcccaggctccgccccttccttgaggcggcccggcgccgcacacggcaatatgtcttggaataccgcgcccccacgactgaggagcgggagcggggcatcgtcgccattccgatcaaggacaccaagaaggcgattgccagcgctgcccgtgccgcaaaccttaccgacgtgaccccgcacacgctacgtcactccgccgtgacttggctggttcagagcggcgtgcctctgtgggaggtggcgcagtgggtcggaatgtcggtggagatgatcgagagggtctatggccaccacgcgccggatcggttccagcgggtgttgggggcgcaacggtgagcgggtgatgaaactcttcgacgccttcgtcgtgaaacaatttcattcttttcacgcactcatttctcaggcagaatccggggccatgagatagcgaacgcatctaatgcaccgttagggtaacttgaccaactggttcgacagttgtatcaagcgcgacgttttgcaacgccacgctcccgtgggagggaattcgacgctatgactcggaaagcagcccggaatgcggctgattatcccttgccgatgccaatcggcctttcgcgaaaggccgtgtacgagatcggcaacgatgcagccgatctgttcggaatgggctcctcaggcatgcctcccgatgaggcactcgaacaactggaagaaattgtggctcgcctcggcggcgatatcatacgccttggctttgccgaattgacggcgcaagagatgcgcgtcggctcgatcgaaattcacagcgaggaagagttcgatatctacctgctggatgaagtcggcatggggccgattgctgcgcgcgaaacgctggcacacgagctgggtcattacattttacaccaccctctttctgacgacgggacattgagggccaaccacatgggtgaaggcccctcccagcaggcagaaaacgaggcaacttggtttgctgaagctctgcttttgcccgatgccgctctgcgtgacgctgcacagaagaccaatgcggctaaggtattagccaggattttctgcgtgtccgaggcgaccgtccgaaatcgtgctcgggctctggatgtcaaagtcagctaggactaaagataagcccaacgggaaacgaaaagagcggggggccgatggcttcccgcattgggcgcttcgcatgttttttagcgtggatatggtcgggtcaaccgcctacaagcacgcaagcctaccaacctccccagagccgaagcgccgccgactagcctcgaaacccgatctacctggacctcactggcttccaacatttgcggaattttatagcgcattcagcgaggagttggaccaggcttggcaagtgggcctgagacaagttcaagccgcaggcgaccgcgcaattcccatcggccaaggcaagaagccggaattctggaaatcggctggcgacgaactattatttcactgcctcgtgacatcgccaagccatgcaggcttctgcctcgatgcctttcggttagcgatcatcaattaccgcgcgaagttggcaaaggctaatcgccgactaaacctgaaagctaccgcgtggctggcaggcttccccgtgaataacattgaagttgtagttggcgctgaaccggattggctgcgcgaattaacccctgcgcttgcagatgatcacatcacaaggatgctgctgcgcacacgaaacaaactcaatggcagcaaaaacgatagcgggcaactggaattcatcggccctcagatggatttgggatttcggctagccgctcatgccaccccgcgccatatggttatttcagcagatctcgtctatctcctggttgaaaatcacctggactcgtatgggttccaggtaaaccactacaaaacagagtccgccagcgaagcaattcgccttgatggctctcacccgctcaagggaatccttggaggaactccttatccaatattttggattgactgcgatccgaacgaattgaataaggctgaagatcgcatgctggaccctcaacgccttggaaagggtgacataaaagactattgcgaagcttttttcagggcatgtggcgaacggtggatggtacgcccctttatttgggatcaagcggcaggaaaggccgtatgtggaagtgagccggaaggccacgacgaagtgcgcaaaggatactgttcttaccttgaagggcgagaacgtgcccttgagagcaagcttgccgatgacagcggtggagatcgcgcagacaggccagaaaagatatctgagcgccttcaggccgcagcaagccgaggggcgaaatcggaagttggacaccccaaaggccaaggggaacttccaagtggttcgccgccatccgaggaatagccgcttccaatcagatagatttagcatccccctcacatcccccgaacgaaaggggatgaaccgaaatcaagccgatttagcctgtctgaacggggccgaaatctaagggtttccgcgaacctgacctaggcgcccaatgttctggaggcaggggccggaggttcgaatcctctcactccgaccatcgacaagccgcagagttctgcggtttgtcgatgggtccgcgaagcaaatccagaccagccattgaatttgcgggacaattgcaggacactgagccgtttggcactgtcccggagtgtcccccagtggcgaccatcacaaaacgcttcaatcgcgacggcgaattgatcggctggcaggcgaagattcgccggcacggcttccccacccaatccaagaccttcgaccgcaagaccgatgctgatgcctgggcgcgaagccttgagggcgagatggatcgtggcgccttcatcgatcgccgtccggcggaacagatgaccctagccgacgccatccggcactaccttgatgccgtcgccccgacccacaagggagccgacgttgaagccgcccgcctgggacggttcctgcgcgaggaaccggacctgtgtcgctacgccctgtcgaatctgcgcacccaccacatcgaggactaccgtgatcgccgcctcgaagccgtggcgccgggcagcctctgccgcgagatcaacctgctgcatgcggtactggaatcggtgcggcgccgcgtcggcctagtggacaacccggtatcgcacgtccgccgcccaaaagtgaacgacgagcgcgatgtccgactctccctcgacgaagaagcacagcttctgtcggccctggatgccaccaggaacccctggatcaagccgttcgtgatcgtcgccctggaaaccgccatgcggcgtggcgagatgctggcgctccgctgggagcatgtggacctggtgcagcagaccgcccatttgcccgagaccaagaacggcaagggccgtaccgtccccctcagcagccgggcggtgaagaccctggaagccctgccccgatcaatcggcggcgccgtgttcccggtgtccttggactcgctcaagcacgcctggacccgcgcccgtgatcgcgccggcctccaccacttccacctccacgacctccgccacgaagccaccagccgccttgccgagcgaggctggaacatcctcgaactggcagccgtcaccggccatcaggatttgcagatgctgaagcgctacaccaatctgagggccgcggacttggcgaagaagatggggtagcaaagagtgctggacgaactgccgtggtggccacccgaccactcacccgattccagccccactgcgcgacattcccacgacgcccgcttcgcgcccatagaggtcatcctgcggatcagtaccgtcccccgttagcggccattgcgttgaagaactgtcgcagcggctaccatcctcacgtcagtcacaattggccaagaggagaacggctatgggacgctccgaatttgatccatgtgcgaaagatcagcggccgtggaacgcgggccaaaaggttggcgccaagcgtgcgctgaagccgcagcaagtttgggctatccggttctggttggatcgagagcagaggttgcgcgaccgcgcgatgttcgacctggcgatcgacagcaagcttcgagggtgcgacatcgtcaagatcagaattggagatgtcgtcagaggcgggcaagttcgctcaagggcgatcgtcgttcagcagaaaaccggccggccggttcagttcgagctccttgaacccgctcgcaacagcattcttgcctggctcgatcgtcgaggaggcgcgcttgacgatttcgtgtttcccagcagggtcgatcataccaagcacatcagcactcgtcagtatgcgcgtctcgtcgatgaatgggttactgggatcggtctgcgtccggaggactacggaacgcattctctgcgccgcaccaaggcgtccatcatctacaagcagacgggcaacctgcgcgccgtgcagatcctgcttggccacgccaaaatcgagagcacggtccgctaccttggcgtcgacatagaggacgcgttgcatcttgccgaaagtaccgaaatataagactggagagaattcctcggcttcagtgccgaggaattctgccatgctatccgcatgacctgagccaagcccaactcggtcggtatcacggcaaattaggggggcggtataccgaaatcctgatgacgttgacggcaggctgcgagccgcgtcagaccatgatcgtcgggtccacccagacgtcgaattgctccgccgtcacgtagcccgtcgccagggcggcttggcgcagggtcgcccccccggcatgggcggacttggcgatctcggcggcgcggtcatagccgatatggggcgccaacgccgtcaccagcatcagcgactgctccagcaattgatcgatgcgctgccggttggcggtgatgccgcgcacgcaatggcgttcgaagctcgccatgccgtcggccatgaggcggacgctctgaaggaaattgtgggcgatcagcggtttgaagacgttcagctcgaaatttcccgaggcgccgcccattgtgatggccacatcgttgcccatcacttggcaacaggccatggtcagagcctcgcactgggttggattgaccttgcccggcatgatcgaactgcccggttcgttttccggcaggctgatctcgcccaatccgcagcgcggccccgaagccagccagcggatgtcgttggcgatcttcatcagtgcagccgccagggtcttgacggcgccgtgcatggcaaccatcccgtcatgggccgccagggcggcgaatttattggtggcggaaacgaacggcaggccaagatccgcagccaattgcgccgccacacgggcgccgaattccgggtgggtattcaggccggtccccactgcggtgccgccgatggccaggggatacaaggacggcagtgtggcgagcagcaccgcctcggcatgatccaactgcgccgcgtagccggagaattcctgtcctaaggtgagcggcgtggcgtcctgaagatgggtgcggccgatcttgacgatagcagcgaactcttccgtcagccccaccagggtctttcgcaggtgggcgagtgacggcagcaggcccgtcaccaccgtgacggctgccgccacatgcatggcggtgggaaagacgtcgttggaggattgccccagattgacgtcgtcattggcgtggacacagcggttcagtccgcgctcaccccccaggatttcggaggcgcggttggccagaacctcgttcatgttcatgttggtctgggtccccgagccggtctgccagaccgacaggggaaattcctctccatgtcggccggacagcacctcctgcgccgcagcgatgatggcatcggccttgccggcggccagcaggccgagttcggcattggcccgggcgcagcctcccttcacccgcgccagggcggatatcagttccatcggcatgcgttcgccggatatggcgaaatattccagcgaccgttgggtctgggctccccatatatgaggttcgggcacctggatgatgccgaaggaatccttttccggccgagtggcgttcatgcgcggctcctctccaggctgacctcgttggagatcatcatgctcccagatccgttcggcgcgttgcgcgatctttcgctcggccatgaaaggctttcccgctattacgccttggccgcccttgatgccgtgaccgatggtccggtgtcgcgcctgccggtatccatccgcatcgtgctggaatccgtactgcgcaattgcgacggcaagcgaatcaccgaggagcacgtccgtcagttggccaattggcgccccgacgcgcctcgcacccaggaaattcccttcgtcgtcgcccgcatcgtgctgcaggacttcaccggcgtgccgctgctgtgcgatctggcggccatgcgtggcgtggcccaggccttcggcaagaacccgaagatcatcgagccgcttgttcccgtcgatctggtggtcgaccattccgtccaggtggaccattacggcgaggcggattcactggacctcaacatgcgccgggagttccagcgcaacgccgaacgctaccgcttcatcaaatggggtatgcaggccttcgacaccttccgggtggtgccaccgggcatcggcattgtccatcaggtcaatctggaattcctggcgcgcggcgtgctcgagaaggacggcatcacctatcccgataccctggtcggcacagattcccacaccaccatgatcaacgccctgggcgtggccggctggggcgtcggcggcatcgaggcggaggccggcatgctgggccagcccctggtgttcctcacccccgacgtggtcggtgtgcatctgcacggacgcctgcccgaaggcgccaccgccaccgatctggtgctgttccttaccgaacgtctgcgccgcgccaaggtggtgggcaagttcgtcgagttcttcggcgaaggcacccgctcgctggcggtgccggaccgcgccaccatcgccaacatggcgccggaatacggcgccaccatgggcttcttcccggtggataaggaaaccgtcaggtatctggaggccacaggccgcacggacagcgaaatcgaggtcttccgcgcctattattctgcccaaggcctgttcggcatgcccatgccgggtgacatcgattacagcgaggtgatcgagttcgacctgggctcagttcagccctccatcgccggccccaaacggccacaggaccgcctgaacctttccgacatgcgccgcgccttcacctccctgttctccgccccagcaaaagacgatggttatggccgaccggccgaggcgttgggccggcgccatcgggtggagacaacggccgccgccgatatcggccatggcgatgtcctgatcgccgccatcacgtcgtgcaccaacacctccaatcccggcgtcatgctggccgccggcctgctggcccgcaaggcggtggcgctggggctgaaagtggggccacgggtcaagacctccctggctccgggttcgcgggtggtcaccgaatacctggccaaggccgggctgctgggagatctggaatcgctgggcttcggcgtggtcgcctatggctgcacgacctgcatcggcaattcgggcccgctgatgcccgatctggagcaggccatcgctgccgacgatctggtctgcgccgcggtgctgtcgggcaaccgtaattttgaggcccgcatccacccggcgatcaaggccaatttcctcatgagcccgccgctggtggtggccttcgccatcgccggccgcatcgccatcgacatgactcaagagccgttggggaccggcaaagacggcaaaccggtgatgctcaaggacatctggccgagcggccgtgaggtggccgacgccctgctcgtcgccaccgatcccgagctctatcgccgtctctacagcgatttcgtccacggcaatccgctgtggaacgacatcccgacccaaaccgggccagcttatgcctgggagacgtcaacctatatcgccgaaccaccgttcttcgaacgcttttccccgcagcccgccggcgtcggcgacatcatcggcgcccgtgccctggcgattttcggggattcggtcaccaccgaccatatcagcccggccggctccatcgccgtctcttcacccgctgggcaatacctgctggcccacggcgtcgccgccggcgatttcaacagctatggtgcccggagggggaaccacgaggtgatgatgcgcggcactttcgccaacgtccgcatccgcaacctgatgctccccgccaaggtcgacggatcgcgggtcgaaggcggcctcaccctccatcagcccgaaggctcggagatgccgatcttcgatgcggcaagccggtatcaggaggcgggcattccctccatcgtcttcgccgggaccgagtacggcaccgggtccagccgcgactgggcggcaaaagggccgaagctgttgggcgtccgggcggtggtagcgcaaagcttcgagcgtatccatcgctccaatctggtggggatgggggtgcttccgctgcagttccgggacggcgagtccgcggcgtctctggggatcgcgggggatgaggaattccatgtccgcggcctgagcggggtcttgcggcccaggcaggaagtcgtcttggagatcgtcaaccgccaaggccgtagccgtgcgatcagcctgcaattgagggtcgataccgccatcgagctggactatctcagccatggcggaatcctgccttatgtgcttcgtgacttgctggcggcgggttaatccgggctcggcagtgtcgggaccggcaagaaaaaattggaatccgtcagggtgatggccgagatgatccgcgtttccccctatccatccagacatctgaggcggacatggagaaggccgtcgacggtggtccatatccggacgacttcccagaccttgtcaaactggtccatggcctttctgaaacggtcgccgagccgcaggggggagaccggccgccccagccgcaggaacctgaatagggcacgtcccgccatggcggccggtcccgcatggccagcctccagcaccattggggccagaggctggccgatcgtcaccccacggaatcgggctgtcattggagccgcctttgcgtgatgaggatgagagcctccatggcgctcatctcgatgccatcgcgggccatcaggcgatggatgatggggtcgcgcagaacttcctccaaaagcggctcatggccgccgaaagtcggcagatgtgcgggcaatggccgggaaggtacaaacttaatccatggatgcgacattttggcgtctcccggtttcagctgcatgccatggcagcagccatgattagcagtagtgaatgcttgccgtgaatcgccccaacatcacagtcatttgataataaatgatcaagaaacacagcatacactacattgcaatttcgtgtgatttttatttaattattttacaaaccccgtcagtccgtggcgataatattaccataatcagcgccgcgatcaggcggtatccttctcgaaggttagcaggatcagaggcttgccgctcgtcctgcaaacgatccgccgaccgccaagccgcatcttgtgactatccaaggggaaagcggagaaactttgtttgcggggcaggacgttttcgagcaggtccttcagcgcaggtgaatcccacgcgatgtagtccagggaatagatcgaccgcccccttgcctccccaggtgagaccttgaaatcgcgatagaacgaattgctggcaaagatgacggagaaggcgccgtccagcaccagcaggggcttgtccaccgcatcgacgatgctctcggcgatgtcgtggccttcctgctcggcctgctcggcggcgacgcgggcagtgacgttggaaaaggtgatcaccacgccgtcgatgacgttgtccagggtgcggtagggctggatacgggtgagataccagtcgccgccgatggtgcgcacttcccgttcaaaggggatcagggtgtctatcacctgctgcgcctgggccagcaaatcgtcgccgcccaggtcggatttgatgtcggccaaggggcgtcccacgtcggtggtgaccagacggtaaaccttggccgcctcgcgcgtgaagcggcggatggccagtcggtcgtcgaggaagatagtgccgacattgatgttgtcgagcaggttcttcatgtcgttctgcatgccggccagttgctcgatcttggcctgcagttcggcgttgacggtaatcagctcctcgttgaccgattgcagctcctccttggaggtttccagctcctcgttggtggattgcagttcctcgttggtggattgcagttcctcgttggcggatttcagctcctcgttggaggattgctgctcctcgatggtggcctggaggttttccctggtataggccagatcgcgctccagttcctcgatgcgctcgcggtcggcggagctgggggcgcggcgacggcgcgccggctttccgggatcagagaccggcagatcctggaagctgatcagcaccagccccagaccgggctcgggatccggcagcggcctgacgcccagccggactcggcggacctcggcgccgaccatgaacgacacctcccgctccagggtcggtgtgccgtgactgaccgcctggcccagtgcgctccgcatttcgagctgcaagccttcatgggccatctccacggcgttcagcgtcgcctgtccgggcggggggcgcagatagcggctggtgtcgccatggacatagagaatgtcccccttgctgtcggtcatcaccgagaccggggcaaaggactggaccagcgcccggcgggtcatttcggcgatgttggtgtccttggtcttggtcatcacttccacgggggggctgcgggtggcgtcggtggtccaggcgagaccgctggccatcatcgcccgggtcgaggcgagggatggagctgtccggtagaacttccacttccggttcaagggcgaaaacagctcggtatggccgccgatgctctcggacggcgacaggaacagcacgccgccgggcctgagcgcgtagtgaaaggcggggatcaggcggccttgcaggtcggcttccagatagatcatcaggttacggcaactgaccagatccatccgggtgaaaggcgggtccttgatgacgttctggatggcgaacaccaccatctcgcggatgtccttcttcacccggtagccgttctcctccttgacgaagaagcggcgcagccgttcgggcgagacgtcctgggtaatgttgacggggtaaaagcccgtgcgcgccgtggcgatggcgtcgtcgtcgagatcggtgctgtagatctgagccttcagttcacgaccggattcctccatgacctcgcgcaggaccatggcgatggaataggcctcctcgccggtggcgcagccggcgacccatagccggaccacgtaatcgtcgggcttgccggcaaggatctgcggcaggatgtcctttttcaggatggcgaaggcttcggggtcgcggaagaagctggtgacgttgatcagcaactccttgaacagggtctgggtctcggcgggatgcgccttgagataacgggcataaacctcaatatcctcaatatcgtgctgggccatgcgccgctcgatgcgccggccgatggtgcttttcttgtagccggaaaagtcgtgcccggtccccgagcgcagcagcatcatgatcctgctcatgccgccgatggtcgccggggcaggcgaaatctcggcatggtggcggcgattggcctgcaagatggcgggcatccgctcgggcgccagcacatgggtggcgaagccggcctggatggcgctgagcggcatgccgtcgtattgggcggtggccgggtcctgcaccaagctgatgccgccgccccccagaatggcgcgcaggcccagagtgccgtccgagccggtgcccgacaggacgatgccgatggcgtgttcgccccgatcatcggccagcgagcgcagaaaggcgtcgatgggcatgcgctggccgcggggctgttccggcaggctcaactgcaaacggctctgaaacagggtcatgtcgcggttgggcggaatgacgtagacccggttggcctcgaccagcatctggtcggcagcctcgaccaccggcatgacggtggtccgctgcagaatctcggtcaggatgctggtgtggctggggtcgagatgggaaaccagaacgaagcccatgcctgtatcggccggcaaattgcgaaagaaggcctcgaacgcctccaggccgccggccgacccccccagaccgacaatggacagttcggccgcggggggctgaggcaaggtcttgctcgtcaccggaaatactcctgagccctggcgggattgcgtgcccttggcgcaggtgcgtcaggggtccggtgccgtgaagaaaaacgcgctgcccgccccgggggtcgattccacccagatgcgaccgccatgatgttcgacgatcttcttgcagacggcaaggccgataccggtgcctccgtaccggtcgcgggtatggaggcggcgaaaaacggcgaatatctgctcgaaataggccgggtcgattccgatgccgttgtcgctgacggaaaactcccattgatgcccgtcgcggcgggcggtgacggtgaccttgggcggtcggcccgggtcgtgatacttaagggcgttaccgatcaggttttgcatcagccggacgaactggtggctatcgtagacgatctccggcagaccggcatgaccgatctcggcgccggattccgcgatggcctgggataggctgaacttggcttcctccaccgccttgccgctgtcgaacggctcccgctctcctcccatgcggtcgacccgcgagaattccagcaggtcggtgaccatggcctgcattctggccccgccctcgaccatgaagtcgatgaaggtatgggcgtcgtcgtccagccggtcgtgatacttcctttccagcagttggccatagctgaccaccatgcgcagcggctcctgcaagtcgtgggaggccacgtaggcgaattgctcgaggtcccggttcgaggctcgcagtctctcgttagcccgcagcagcgcctcgcgggtatcagccagttccgcctcggccgtcttgcgcaccgtgatatcggtcagagcgacgcgcaggaccggggctgcgtcctgttcctgcaactggcaatcgagatggccgttgaagttcctgccgtccgcccgcagaaggacaagctcgcattcgtgccggccggtatggtggagggcatgcgccagatgccgatgccagcggtcatggtcggtgccggcgacgaaggcgtcgaagcgctgggcaatcaccccggcgcgctccactcccagcaaggccgcgccggtcaggttgatctgggtgattaccccaatacgggacaggattagatagccgaccggagcgaattcaaagagatcgacatagcggtcgcgggattcttccagagccagttgggcccgccgcaattcgtcgttctgcatctccagttcgatctggtggacgcggagttcgtggagcaggtgttctggtgacggcggcgtttcgtcgccagggtgctggttcatcaaagcccctttccacccaaaggcacagtctacacgacttcgtgccaatggattaaagagtctagccgttaaggcgaaatattcgcccgaagcttatcaattcgggcgtttgccagattccgggccgcttgaatattccgccttgcggccatgtccgcccgccgcaaggtcatggctgcatcgtccgcggcatccaacaccacgctggcggccaaaccggattcggggcggcaagcttcgacgcctcctctcagggcgtctaaggcgagtcctgcatcattttgggtcttcaaggacactccaactgccaggatatggatttgctccaaggtggcattgccgacggcccccaattcgccggctcccgcatccgcttcaaggcgaagaatctgatcaaggggaggcgcggctgtggcggcaatggtccacaacctctccttaatggcctgcgtcccggccgacaggtgcgtgcaggccatggagcagagggccccgatacgctcgacggcggcatccacatcatcgttaaagtctgaggccagcagatgagccatggcgatgcgaccctgcgcgttcccgacaataggcttgaggtccggaggggaattgggcatctggtactcctgccttacttcaggatgtcggccggcccctggcgcagatgcgggtgatgtcccccggcaaatctagtcctgggcgatcttccggttgatggcgattgcggaatgccccctcagactcaggctgatcggaatgcatcccggattcatcgccgcacctcccaccagggaacatgcctactgggatggtattgcataataaataaaatacaatacgcgctgcgcgttatcacaaatacccataaataggtacctaaaataacctgtctttattggcgattaattcggcgcatatcaattgtgatattattatttggcattatatatattacaccgacgccgcaagcgccggcggaggatgacagcatgaattgctcacaatcaaaagcctgccatttcataagcgaatggatggttccgccactactgatcccactggccctgattctcatgatcgcgatctgggtcgccgtgcgcccccatctgggctgagccgcaaccggagtgccaagcatgaccgtcaatacgatggcctttcctgtctcccccggaatcgaggggatgaatacgctggccgtgttcctcaacgcctcgcatcccgcggggggatggcatttcggccgcggtacccgcttcgaccaggccatggtggacatcgatttcgacgaccccgccgacttggcccctgcgtggcggagctattgcagcacccgggctccatgaaccgggatcagcggaagggaacgcccatgtccgagagcacgctcttccaactcagccgtatctatgccggcggttggcttgcggggcggaacagccccgacaccgatccggccgacatggattccgtggcggatcgcctcaatccataccaagcgcccgccgaaagtcagcgttggaaccggggattcaaggatgcggtattgcgcatccagggtatccgggtgaaatcccttgaccggcttgtaggagaataaagatggcaaaaggtcagaaacgtagcggtcgcgagcccaaaaagccaaagaccgcagtaaaaaaggcgtcgcaagcggcatcgctctttaccgacgacagccgtatgggtaagaagccgccccgcgtcaccggcccgccgccgccaaagccggaataagcccggattcagtccgcctcccgccgccgggcggtacctgtcaggtgccgttcggcgaaggctttcatggacaggccgatgatccagtcggaaataaccatgggaatgcgtgacggcgtgaggaaggggaagctgcgcaggaacggcaccatggtcgtaagcccccccgacaggatgcccctgaccagcaggcggacgacgataccgacccgctggcccatgggatagccgctgccatagaccgggacgcgcagatacgccgccttgttgcggatacgccgcccgatttccgggccggtgagcaggcggccgtaaagcatctggtagcccgccgccatggcttcggcggtcatgcatttcggcacgatgttggtggtcaggctggtgttgtccgaatgtctttcgacgggcagcaggcggccttcccgctccatccgcgcgtgcagcggggtacgcggcagcgccatgagcagaccgatcatggccgactggattccggcgtcagtgatgaagcggtactgatgctcgaaggtgtccagggtgtcgtggtcgaagccgatgataaacccgcccagcacatcgatgccgtgggaatagatgcgccggatggccgtcagggtgtcttcccgcaggttctgggtcttgccggtttccttcaaccccaccggatcggtcgtctcgatgccgatgaacacccagccgaaattggcggcgcggaacagctccagcaattcgtcgtcctgggccatgttgagcgacgcctcggtgccgaagctgaacatgtagccgtgatgccgctggtactcggccaggaaacgcagcaggtccttggcctccttcggattgccgatcaggttgtcgtcgacgaaaaatacgctgcgggcgccgaagcggcgcaactgatccaactccttctcgatctgatccaggtccttgacccgggggcgccggccaaacatcacgatgatgtcgcagaactcgcaccggaagggacagccgcgcgagaactggagggtgacgttggaataggcccctaggcgaagcaaatcgtagcggggaaccggagtgtccgctaacgccaccgttccggtctcgtggtacaggggctttggtgtccctgcctcgaagtcgcggcagaattccggccacacgtattcggcctcgccggccaccaccgtgtcggccgcctcggtatactcatcgggacacagcgaggcgtagctgccgcccgcaaccacgtaatggccttggtcgcggtaatgggccagcaattcccgctggcgctcgaactgaacgcccataccgcatacaccgacgatgtcggcgtcggtggtcgggggaatcggttcgatgttttcgtcgatgatctcgacccgccaaagggcggggcacagcgccgccagcgttgccaggccgagggggggattcaccgccttcttgcccggcaacacatgatcaatggcccatctgaagctccagaagctttcggggaacctcggattgatcagtagcagactgggcatccgcgtctcctgttcccttactccggcaacgcgctgctgaagaaggggagtatcacttcaagggtgtcgctgcgtatccgctcgcgcccgcccaccttgacgaagaagcaatggtcgcggtgacagtaggccagttccttgacggcgcctgacgccgctttacaggccatgatcggtgtgtccccgctcccgttggaccgagacaccacatcggcaacagtctgtcggtcgatcatatccgtctccggagcaggaatggggatggattgggccatccccatcgcctgtcagcctacttgccgtccagcgatccgagaatgcatgacggtagggcggacaaagccgtgaacgcttcgcaagcggcattgatctgacgctctgccaattgggtattggcgtccatcagacgctggacctgcttcatcatgtccgaggcgctctcctcgactttggccgacgcggacctttcgtcggtcaggccggatatcatcgctttggcgcaggtcgaaccgatgtcgcggacctcgttgccgtaatcggcatatcctccgatcacggcttgaccggcgacccgggagatttccgccaaatccctggcgcatttgaacataccgtcacgggcgatggccgaggtctcggcccattgagccacggaaatcacgttgtcgatggaggtggtctccgcggtagctttggcggaattggccttgactgtcgtcatcgcggcttttcctttggttggattgaaatttcagtggatggcgagtgttacgaaattcgtgccccctgcatgccaaggaacgatgtgcccggcctggggagcgtttagtccatcagggccccggttgttcagcctcacagataaagctcacggcggcggcgcggatgatggggcggagcctcccgtgctccgaagtcggatcgaaagccgatctaagacgaccctttttgtatatttgtcccaccatccagggggcgaaccccccgccgccgccgccctcgcggtaggccaacacggccctggtacggatgcgcgcgatgtcgccgcctgccgccaagccatgagccacccgcctgttgatcggaatgatggcgccgatatcgtcatcgttgacgccgcgaccttggcccgaggagccatgaataacgaattcggcgtcgcgggacgtcggaacggcccagccgttgccgacgccgcattcgcggaccacaagccacacacggaaattggcgttcaacgcgtccttgaaggcggccgtgtcgttggcggcctcgatgccgtcggcggcctccatcagggcggcgatgcagagttccgctaaagtcgggtggagatgcacgagtgccggagtcattaccctgcctcccaggtgcggctcaccgatatttttccagccattgctcgctaaaggtagtgcgtagcggaggcgtggacaattcccggttatgtgcacggcgactaccctgaaacaggtaggctcccgcgactccccttacgcaatcacgagggaatcagcccctcgtgaacggcatagcggatcaagtcggcagtacgattcatcccgagcttctgcttgatattgcgacgatggacctccaccgtccccacggcaatgccgaggctggcggcaatttcggcggagcgcaggccgcctgccagtagaaccaacacctcccgttcccgcttgcccagcacgctgggcggcggcgcgacggtgtctgcatccgactggatatggcggagcatgacctgggttgcttccggcgagaggaagctgcttccccccgccacggcgcggatggcggaaaccaactcatcagctccggacgacttaaccacgtaaccatgggcgcccgccttcagcatctcctcgatatagatgcggtcggcaaagcccgacagggcgacgatacgcaagtcgggatgccgcctgatcgccgtacgagccacctcgataccgttgaggtccggcaggccgatgtcgagaaccagaacgtccggacaggccagatcaagggaagccaaggtatcggcaccggaattggcttcggcgacaatctccatgtccgactcggcttccagcggcgcccgaagcgcctctcggaacatgcggtggtcgtcgaccagcatgacgcggatggtcatggcagcatctccgtgggcgcggaatcattgtaatcgaacggcatttccaggacgacggtggtcccctcgcccgggcgagtttggatgtccatgactcccttgaggaaggtaatgcgctctcgcacgctggacagtccgaaaccacgccgggcttcaagggttgctcgccagtcgatgaaaccgacgcccttgtccgcgaccgtgataatcaggcggttattgcagacacgaagtccaatccgggcagaacccacacccgcgtgcttggcgatgttgatgacaagttcgcgcacagcccggaacagaagggttgactgtccctcggtgaggggtttcgggacgccgtcgtcttccactacgacctgcaacccgcggcgccgccccatttcgtccgccagccacgatatggccgccaccaatcccaagtccttgagcgccgggggactgagtttggaggtcagcgagcgcacttcgccactggcctcggagagaaggccgatcaactcaagcgccaaggtcgcggtgggaagctcctgcggcagagccttcaccagccggtccagtttgaaccgggccagatgcagcgtctgtcccaggccgtcgtgaaggtccttggcgatggaatggcgctcccgctcttcggaaagcgtcgcctcgatcgccagattgcggagatgttccatatgcagggcgatgcgagccgcggcttcgtcttccttccgcgcggtgatgtcgcgcagcgccgtgagacgaaaagcccgcccatcgtcgctgaatggctgaccatgggcctcgacctcgatccgggaaccatccctgcggaccatgccgtgctcgatatggctttcatgaccgcgatggatattgtccatgacgcgatcacgatcctcgtcggagatcaactccgccaccggtcggccgatcaactctgctcgtgggaagccgagcatttcgaccagttgctcgttcacatcgacgatgcgccccttggcggagatggcaataccttcgaaagtcgacgcggcgagcaggctgtaacgcttctcgctggcttgcagcgcgatttcggtctgcttgatccgggtgatgtcggttatggcgacccgaaccatcgcaccatggacggcattcgtgacccgcaggcaatccagacgtgcctcgattgtgccctcgtcccgacgccgaagccggaggtcggttgttcgatggggatcctcctggtcgttcagaatggccgccatgaaacgatgccagtcgtcgccgcttacctccgacaccagggcgctgaaccgcaatttcagcaaggcggagcgctcgaagcccagcattgaagagagagtcagattggcggattcgatgtggccggatgaacccagcgtcacgtaaccgaccggagcgaattcgtagagatcgatatatcggtcccgtgattcttccagttccaattgaacccgacgcagttcctcgttctgcatctccaactcgatctggtggacgcggagttcgtggagaagatcgctctccccctgattccgacgagcctgcacctcggccttcgcgcgatgcgcgtcctgagatttatccactttggaagagccgggcctcgtggtcatgatgtgaacctctgctccacgcccgatccaaactaggctattgccattcttacacggtagcaaagaatcgctggaagggagccgcggttgtccgaccaaagggcgcatgcgcgtcggcgatcctagaataccatgccgacgttgtcggctttgcctgtactggacccgatagccgcccgtccgcttccggcccatggcggtcgttccctgaaatggtagcgtgcggtgagactacatcccatcgatgcccccgtcccttgagcgcttcggggatgcgacaccctccacctgagcagatggcgggcgaggcggctcttcattcgaaggccgcgacttcaccaccacctgccgcagatgcccgatcagttcgtcagcaaaggccgccgtgataggggcgtcgctcgacttcaattggcagtctcgctccaccagcatggtaaacaggatgcccagttgcttcgccgtcgccgggggatccggcgtatttgccggacgccgtgcgagcgcgtcggcgacacgcatttccacccccgcatcgatctctatctggtcgagccgatgagcctccacctgcgcctgccaggctcgtcgggcctcggccactttttgcgctgtgtgacgcgcgctctcagcggcggcttgcgttcgggcatgctgctcgcggacgcgggcctcctcttcgacctgccgccgttccgcctggcgcgcttccgagatggctttgtccgagaaattggcaacattccaatggtcgatcccccgctcggccgcaagctcggccaattttcgatccagagcgtcgggccgcgtggtggcaatgggcaggtctccgggctttggttcgcccaggaagatctggcgcgtcccgaagcctgggactttctcgataacgaagactgtgagctatgagctactccccggaaattggacactgacggaagctacgatctgatgtttgctgatccccaactacgaggagatcagagatgtcgaagcgcaggaaccatgacgcggccttcaaggcgcgtgtcgcccttgaggcgctgaagggcgagcggacggtatcggaattggcgtcggcctatggcgtccatccgaccatgatccatcaatggaagaagtccctgctggacggggcggcggagatcttcgaacgcggggccaagaagaaggccgaggtggacgaggatacggtgcgatccctgcacgccaagatcggggagctggccgtggccaacgattttttgtctcgaaagctcaagccgtggaccggcaagtgaggcggaccatgatcgagcccaaacacccggcgctgtcgatcggcgcccagtgccacctgctgtccattgcgcgatcatcgttctattacgagcccttgggcgagacggaggcaaacctggagctgatgcggttgatcgaccgccaattcctggaaacgccgttctatggtgtccgtcagatggcttggcatctccagaacgagggccacccggtcaacgtcaagcgcgtccggcggctgatgcggctcatgggcctgatgccgatctaccagaagcccaacaccagcaagcccgccaagggccacaagacctatccctacctgctgcggggcctgcggatcgaccggcccaatcaggtctggtgcgccgacatcacctatctgcccatgcgccggggattcctttatctgatcgccatcatggactgggccacccggaaagtgctggcctggcgcatctccaacacgctcgaggccgacttctgcgtcgaggtgctcaacgaggccatcctgcgcttcggcccgccggagatcatgaacaccgaccagggcagccagtttacatccttcgcctggatcgaccggctgaagcgggccggaacccgcatctccatggacggcaagggccgttgcatcgacaacgtctttatcgagcgcctgtggcggtccctaaaatacgaatgcgtctatctccatgcctgggaaaccggctcgcaagcaagggccgggatcggaccctggatcaccttctacaaccacaaacggccccacgccgcccatggcggaaggacccccgccgtggtctactggaacaccatcaaccaaaccgatcagcaggcccggagagtagcttaaacttccccgaattctgtccaaccaatggggagtagctcaaccacaacgtcgatgttgccgttctcgtcccgcttggctcgctcttcggccaattccaacgcggaattcattttggaaaggcgtgtccgcatccgccccttgagagcgtcggagaccttgatcgttggggccttcatcttccccaggccgaatactgccttaagcagtgggccgaacttgctatcttttccgggagcaagattgacgccctggctgctgatgtaattgtcgtagtcgggcgtgccgtagtaggccagatagaaggcatggacgcgggtgagagtgagatagataagtcgccacacctcggcctcgccggaagcaacccggccatcagtcaggtaggcgttatgggcagcctgttcgcaggccgaagccgcgtccatgtaggactgcttgccggggagggctgcctcgatttcatcggccgacatgccctccgcgtcgtcggcattctcggcgggaagatcggccctctggtcgagccctgcatcgtcggaagaggcgatgtcgtcgccgataacgttaccggaagtaacgatattttcggtctcgggctgcggcgcggaattgttggtctgatcggcgttcatggcggtctcctgggtgtcagtagtggtggaagtggcggaaagtttgtcgttggtgatcatgatgttctccagaggggacgggttgggtcaggggaaggcgatcagcggcagccactgctcgggcctgttgctgcgcagcatttggacgatcagcgggacgagattccgttcgttcgctacgaagtagcggtcaacgactgagtaggtctgacgcaggaaggcttcggtgttgacgaaggccatggccatctgcccgagcgggtttaggccgccatttgccttgtctccctggaggatgtaggccgaatgaagcggcgtcccctccagcacggtgcccttcagaaggtcctcggtggcgctgatttgccacggggtgaagccgctaaacgggacggcggtcgtgtagggaaagaccttgccctcagcgaacagcagcggaaagcgatgggcaccgtccttcttcaaggagctatcgggtaggcgttgcgtcgcaacgacattgccggtgccgagatatcggctgccgccctttcccatgttcttggtcgggttcgaggagtcgcaggagatcgtgaatttggggtcacggagttcgtaccgaagcgccttctggatcagcgagaagatcgcgaccatccgggcgtcggtgacgccgaagacatgcagccaattgttccggccggacagcatgccgtcgtggtacatgtgccaaagcaagagcagcaaatcttcaggctccagccaccagagcccacccagcgcccaaccctcgcaggcttgttcgccccagagccgtacctcattgaggtacttgatgtgccggtaccagtagagcaggctttccgggccatatccgcccgtcagcccttggatgacgttcagtaggcggtagagccccgcgatgcggtgccgaagctgatccaagatgttgctttcggtgcgcagatgacagttctgataaccggggatgccgggcacgcccctgcggaacgcggcagtgggcacgtccatgcccgcgacgatcacgttgcccatctgggcaaaggcgtcctgccaagcccagagctgatgtcggcgctggaagtattcctggacgctgagttggccagtcgccaccgagaagccgccgctatcaagaaacgtcgtcccgagcagcagattgcgccgccatgcagggcttacttccgcttgtgaggcaacgatattgaggttggcgttgcccgcactgaccaaggcgtaggggtaatggaagtacccgctggtgtgctggaagttgagaatgtcaaaggacttgaaaccggcataggcaaggaacttctgcgcccgagggtcattgaccagattggtgttgaacggctgaagcgccggaaaaatgatcgccctgtggcgggtcagggacgtgaggtcgggtggagcccaaggtggggctgcggagcaaaatggtgtggacacgataattctcctcatttctgccgttggcagggtttggactacggaacggctggttcgtgagggctaggcgatctcgaccacgggggcgcgggcatagcgatgcccgacgccttgcccaataggtcaagacaagaggttatgccgattgaagtggatttattccgcaatgcatccaggcatcacattggcgatgccgggagctactgagaatacatctcgcatctatatcgcattatattccttcgctgttgccgcacgcattgcgcgttctcgttgatgcgatcctattcgcgtcgatatatacttacaattatgatttttaatgcgaatttatcgtcacaatgacttattgcagcgcatcgaatatttggtatgtagcgtttcaccgcgttttggggtgggctacgcgggcggaagggggctttggggctcggcatgcggagagcaaaacggtcgaaagataacgtgttgaaatttcacacctttctctctgtgtttttggcacttcttcacaagggtgcagcggcgcactgtttcacgagcttccgagtggtccagatgctcaaaaccggcatatatgcctgacgcatagttgacatttcatctaatatgtgtattctggcgctcgggtggcggcaaggaagcgaaaaagagccgccgaagttaccccggcgacttcatagatcggtcttggctattgggatcgcgttcgttaggcggatggctgttaccgccggtaacgttccgcgcgggtcagtactcgtcggccagcatgattaggaggacgcgcacagtcaccgccgggtcggcgggatcgggcgaggcgaaggtcagttcccggtcgtaggcgtcaatcttgaagatgatgcgatgctcgccaacggtcatcacggcgcagtcgtgttcatggtgcggatcgttgtccggcgtgaagtccgagaacgtggcaacggcagcaacgatctccgtgatggtgtcctggtcgagggtctggatgccctgggtaatcatcacccgaccaccgatatggtgctggcgtagtcggtcgttctgcttggcaatctttgatgctcggtccatgcggctcccgctgtggctgagggcgcgtgtccgaagtgggcgttgcgcccgttgcgctgctatagcggtgggccgcgctgggcgtctacggagacctattcttcatcctcagcgagaaccaaatagggaaagcggtgccccttcggcttaggctttgccgtctttcgtcccgccttccgcgccgcgtcaacaagctgttcgacggttccggtcttcggcctgaattcgggctttacatgcgtcagctccttggccttggcgctgttcctggcatgcttgtagtggtgcttaatcatctggaccgaggtgcccatgttctccgacaggtcgaagacattgacgtcgccttccatgaggcgggtatcggcataggtgtggcggagtgaatacggtgtccgcttctgcttcgtccgtccgatccggaggtcggcctccttctcaagatacaggtcttcaagcatcctggagaacgtggcgctgggcacaccgagcttctcgccacgctcgttgatgaacaggaagtcgtttgggccagtcgcgatttcccgctttctcagccgccggatggcatcggcgacctcgggcatggccaccacgtcccgctccccggtcttgccttcattgaggtcgagaatgaccgtctcttcgccattggcggtatcattgatgtggatgtcgcggttctggaggttcatggcctcgcctgggcgcatgccgctgtaatagaggaagatgcagtaatcccgcagatgctcgcggcgctctcgcgttctgccgttcaccgtcagcgtgggccattcccacagccagtcttccaggattttccattcgtccgaggtgaagccatcgcgcttggtccgcttcttcaggctgacgctgaaggtcgccttggggcgatcctggtagcggatgtaccgcttatcaacggcatgatccaagatctggttgaggatctgcatctcgtgcatcaccgtcgtcggcgcgatgggagtgccacggtaagagctctgtgccagccgccagttgatatagcccttggcgatctcggtggtgagccgtccgatgatccgcaccgcgcattccctgaaatagcgtcgtagcggaatggccgaatggacggcgcgcttgatggctgacttgccgcgcgtggcgtcggctttgacctcggcgatatattccgagatcacctcgtccagggtcttgtcgaacagcgatccgacatcacccttcttcacggcgttcgatacagcgccgtactgcatcaaggcccattgtttggccgtgtcgatgcttgtcgtcggggcgccgtccttctcgcccccttcgcggagaagctggaatttgtaagggcggacgcccttaaccttgaggggaaagcggacgtaccaattgtccccggcatcttcacgctgatagatcactaagccgggcaactcagggaatgcgtatttgttccgcattcctttgcccttgcctcggctcttccctggcatgaactatccttagttgcaaatcacaaagctaacgcaaccgcatttctgtgtaatgactgtgtattaaacactactttagcgtccgatttcgggcaatgtgtaatgattgtgtattcactaagtccttgatttttccacccatccgccgctctccccttgctggtaatagaccaattgatgaccttcggatttccatcgcttccagcgctcccgagccttctcgaccgcgtccgggtcgttgccgtcgaacagatcgaggccgcgctgatacgcccccaccttttccgaagaagcgccgtcgcacatcactaggatggtggcaccgttgggattctcgtccgaatgggttaaccagatgggttgcatttcgggctcgccgtccctggccgagccatggggcagccaggactccggctcataggtccacaggcggtcgttcagggcttcgacccgctcgggcgagccggccagcaccacggcgcggaatccggcggccagcgccttgtccagcagcttgggcaatgcctgctccaggggcaagcgcatcaggtgatagaagccgatctgggtcatgcttctcctttaccatgggaatggcgttccggcgagccgtgggtataatcccaccatcatgacgatcgccgtgatcattccctgctacaaggtgacccgccatatcgaggcggtgctggccggcattccccagtccgtccaccacatcctggtggtcgacgattgctgccccgagggttcgggcgacgtggcggccaaggccgccgacccgcgcatcgaggtcatccgccacgcccacaacaagggagtgggcggcgcggtggtcaccggctatgtccgcgccctcgaactgggctgcgatatctgcgtcaagatggacggcgacggccagatggacccggccgagctgccccggctgatcgagcccctggcatcgggccgcgtcgactacaccaaggggaaccgcttccgccacctgcccgagctgaaggccatgccgccggtccgcctgatcggcaattcggcgctgtccttcctggtcaaggcggcgtcgggccagtggggggtgatggaccccaccaacggctacaccgccatccaccgccgcgccttggaggagctggacctgggccgcctggccgagcgctatttctttgaaagcgacgtgctgatccagctgggcatggccggactgccggtggaggacgtggccatgccggcccgctatggcgacgaggtgtcgtccctgtcggtccccaaggtgatgcgcgacttcccgccgctgctgctgaaggggttcctcaggcgcctgctgttccgctacttcatcagcgatttcaccatcgcctcggtctatctgctggtgggcgtgccgctgctgggcttcgggttggtggagggcatcgggcaatggatcgcctcggtggccagcggcgtgccgcgcaccgccggcacggtcatgctggccgccatgcccaccatcctgggcttccagctcctgctgcaagccatcgcccacgacgtccagacggcacccaaggcgcgaagcggcaacacaccttcatgattgggcactcgcccaaacccatccggggccaagcctcgcctgcccctcgtccctgtttatgaacggcatggaggtttggaggcgtcgcctccaagcggggaccggggcggcagccccgccgtcagcccccccccccgccagggcgtcgaacagcctgactccataccccgtcgcggtttcgggacacagcggatcgtcctcgtcggcaaattcccgccccgccatgtcgatatgagcccagggcagcccctcgggcacgaaatgctccaggaagcgggccgcgtcgtcgttgtcggggacgtcgccccaggcgcagtgcttgaggtcggcgatgtcggacttgatgtcctcgtcgcaggccgccgtcagcggcagccgccacaagggctcgtcctcggccttggcgtgcttcagcaggcgcttggccagcagatcgtcattggcgtagaggccggcgtattcggcgtccagcaattcctcggtggtgccggtcagggtggcgatgtccaccatggcggcgggcttcaggcgctccgccgcccaggccagggcatcggccagcaccagacggccctcggcgtcggtgtcgatcacctccacggtctggcccgagaaagagcggaccacgtcgccgggccgctgggccgcgcccgacggcatgttctcggccagggccagcacgccgcagacatgggccttggcctgtcgccccgccacggcgcgcagggcgccgatcaccgcggcggccccagccatgtcggccttcatggcgtccatgtcctcgtcatcggccttgatggtgatgccgccggtatcgaaggtgatgcccttgcccaccagcaccagcggcttgccctcggcgcctttccagcgcagcagcaccagacggggcggccgcttgctgccctgccccaccgccgccagcaggttgaggccctcggccgccagcgcggcctcgtccagcacggtgacctcgacacccagcgcttccagcaggcgggcgcgccggacgaactcgtccggccccagcacattggcgggctcgtccgtcaggtcgcgggccaggaacaccccctgggccaccgcctcgcgagcctggaacagacgcgccgcctcgtccgggtcgggacagcagacgatcaccgattccagcaccggctgaatgtcgtcctcgtcgtcgggatcatatttggtgcggtatttggacagcgggcgatagcccttgagccgcagcccataggccatctccgccgcctgcccggcgggcaggtccagcagaacggtcaccgccttggcccggctttcgtccagctcatcgagcaaggccccgccgatgcggcgcaaacgccgggcatcgagcttgcgccccttgcccagcccgaacaccaccagcgccgagagcgggcgcggcggcgccaacagcagctcggtctcctcggcatcgccgtcgaagcccagacgcttcagcgccttggccagcaaaccgtcgccgtccagggcggtgaaggatggggtggcaagccgcccccgccacaacccgacggcaatggcgccgtccagggtggcggggggagagcggaaggtgatgcgcatgaacgccccatcaaacctgtcatcccgacaaccgaagggcggagggatctcatcctgatccggcggatcagaaccggcaccatcggatcaggcagagatccctcgcttacgctcgggatgacaatttcctgactacgctacttcttgtcctcgtagaaatcggccaccagccggtccagcaggcgcacgccgaaggcggtggcgcccttggggcaggtggcgacgtccttcttgctccaggccacgccggcgatgtccaggtgagcccaggccacgtcgttggtgaagcgcttgaggaactgggcggcggtgatggagccgccttcgcgcccgcccacattcttcatgtcggcgatgtccgacttgatctgcttgtcgtaggactcgcccagcggcagacgccacagcttctcgtccaccgccttgccggccgccgtcaggcgatcggccagcttgtcgtcggacgacatcaggccggcgtattcattgcccagcgcgatgatgatggcgccggtcagggtggcgaggtccaccatgaatttcggcttgaagcggtcctgggtgtaccagagcgcatcggccagcaccaggcgcccctcggcgtcggtgttgatcacctcgatggtctggcccgacatggaggtcaccacgtcgccggggcgctgggcggtgcccgacggcatgttctccaccagcccgaccacgccgatggcgttgaccttggccttgcgcccggccagggcggccagggcgccgatcaccgcgccggccccggccatgtcccacttcatgtcctccatgccggcgcccggcttgatggagatgccgccggaatcgaaggtgacgcccttgccgacgaaggccaccggcgcctcgtccttcttggcggcgttggaccagcgcatgatcaccagcttggattcgcgctccgagccctggccgacgcccagcagcgagcccatgcccagcttcttcatctgcttttcgcccagcacctcgacctcgacgcccaggtccttgagggactccgccttctcggccagcgactcggggtgaatgatgttggcgggctcggagaccacgtcgcgggtgaggaacaccgcatcggccaccttgtccagcgccccgaaggcggccttggcgtcggcggcggcatcggtcagcagggacagcttcttcaaggagggcttgtcctccttcttctgcttggtcatgtacttgtcgaagcggtacgagcgcagccgggcgcccagcgccgcctgggcggcgaactcggccggcgacaggggcgagccggggatgacgtccagggccaccgccacatcggcgtcgcccgacgtctgcagctggcccaccacggtgccgccgaaggcctgcgccgccagggcgtccaggtccttggccttgcccaggccgaccagcagcacgcgggacagctccagcccggcgggggcgaggatcagcagcgtctggcccttcttgccctcgaagcggcccgaggcagcgatggcgcgggcgaggccgcccttggcctgggcgtccagggcctgggcggtgccggtcagcaccttgccttcgagaatgccgacggcgacggcgccggaagcaggcagggagggcttggaaaaggcgatcttcatggacatcctcacggctcggaacattgggatggaattcactgatcccaatgtagcgcgctgggccgggaaggaaagagggttaccccctcatctcgttcttttccgcctcttcctcggcttcttcctcgatatgctcgatctcatccagcttgggatggtcgcccgagagcatccagatcaggccgccgggcagcgcggtgacgatgctggtcaagccgaacatcagccccagcaccgccgccgagcccggagcaacccccacccagccgaaggccacgatcatgatgttctcgcgcaggccgaagccggcaatggagatgggaagggtcagcgccaggatgaccggcgggaacaggatcaggcaatccagcagggagacgtcgatcttcaggccgatggccaggacatagaccaccagggccagattagcgtggccgaagatcgccaccgccagcgtgcccagactgaacggcacccggcggaccagcaggcgggtgtcgccggccagatgcaccaggccccgcaccacccgccagcgatgcagcgaggcgggaagccggtcaagctggctgatgaaggcaaggccggcgatgcccgccaccgacagcagcgggaacacccaggttcccggaacatcgggcacgcgcgccagcaaaagcggctccatggccgcgaccagcagaaccagacccagaatggtcattatccgctccagcatcacggaattgacgctggtcttgagcgacaggccggaatgattggccttccacatgcgcaccgcgtcacccaggaccggggtgacgatggaaaagcagacgccgatatagaagaccggcaaggcctggattgccgagaacgtcgaccggagggcgcgcagcaccagccaccagcgcccggccccgatgaggacctgtccgatccccagggccagggccgcggccagcatcatggaatcgatggtcttggcccggctccaggcctcggccagatcgatattcctgaacgcgaaccaaatcagtccgaccgagagaccgcccttgagcacccacggcaaccagcgcttcaccatctgtctcgaaatccatcaggacgagaggcgggaagctttaccatattcggcgcgaaagggaagacgggaagcggggccgcccccgtcgcagcccgtgcctggacgcaaccgaaggtgacagagccgaatgcgtgtggctaaatccatggcaccgagggccggggggcgacatggacctgattgcaacgcttacgctgaaattcgggccgaaactggccaaggccatcgccaagctgtggctgcccaaggactccgccgcgctggccgccgccgacgacatcgccgcccacctgtcgaacaggggcgaggatttcaccaccgcccaagccacccgccgcctgttcgaccatatcgtgtccgacatcgtcttgcgcctcggcaagctgatcgacgcggaattccgcgacgtctccgacaatgaccgcgaggccgccatcctggccgtgggcgaagccttcgagtccctgtccctgtccgccgacatgatgaggagcgagctgaacggcctcaccctggaacagaggctggcccggccggaagaggcctccctccagtcccaggacggccgcacccaggatctggccgaactgctgctgcgggaaagctgtgcctatgcggtgaccgtcgccgccaagctgcccgatttcagcgtccccgccacccgggagttgctgaagcgcacactcgagctcagcaccgaattggtgcaggcgctcgacaaggtggaagccatgcgcgacgtggcgcccggcaacgacctcgcccgcaatttcgaggcccagtaccgccgggcggtggcccagcggctggaccgcatgcagttgttcggcgtgcgcctgatcggcgccggagcgcgcgagcctgaaatctcggtggcctatgtgaccctcacctcgtcgcggcaggacggaacgcccaccagcgacgtggacagcgccctggagaagcagacccgggtcatcgttcgcggcgaagccggatcgggcaagaccaccttgctgcaatggctggccatccgcgccgccaaccgcgatttcgaaggcgtcctggccccctggaacgcccgcatgccgttctacgtctatctgcgcgaccacgccgaaggccaatttcccgcccccgagcaactggtggccggcatcgaccgcaagctggtcgggctgatgccctccggctgggcgcgtcaggccctggcggatggcgccctgctgctgatcgacggcatcgacgaggtccccgtcgcccgccgcgccaagctgctggagtggctgaaggacctcaccgagacattccccgacgccgtgctggtcctcagttcccgccccgccgcgctggatgccaagctgtcccacgagaccacgcgcaagcggctgacaaagctgggattcgagcagatcatcctggaacccatgagcctggccgacagcgaggcgctgatcatccaatggcaccgcgccgtcggccgtgatctgaccgacaccgacgaccgcgccaagctggagcgcttcgaacaggacctgatccgcaccctgcgcgaccgtccggccatccgccatctggcgtcgaatccgctgctgtgttccatgatctgcgtgctgaactgggaccgccagcaattgctgcccgacaaccgcatggagctttacggcctggccctgaccatgctgatcgagggcgcgacgccgaccgccgcattcaggccgcctgcctgtcccagatggatctgaccaccaagcgggccctgctggattccatcgcctattggatgatgcgcaacaatgccaccgaggcggaaaggggcgatgtggaggccgagatcgccagacggctggaaaggatgccccagcttgcctccgtcgccgataaggtgctgcaggaattgctggaacgcagcggcgtgctgcgccagccgcagcacggcatcatcgatttcatccatcgcaccttcctggaatacatggcggcccgcgccgccatcgacgccgatgatctgggcctgctggtggacaaggcccgcgaggattcctggcgcgaaaccatcgtcttcgccgccgggcatgcccgcggccggacccgcgaccggctgatccgggatttgcttaagcgatcgttcagcctgttcaaccggcgcaggatcgccgaggacgtcaccgccgcctgctgcctggaaaccaccgccgccgacctggacgccgatttgctgaaaaagctcaaggagcgggccaagggcctgttcccgcccaaggacgtggagcatgcccgcctgctggcccccgccgccgccctcgacccaacgctgctggaaggccacaccgccgaagacgcaatcgccgcctgcatccgctgcgccgccgccgtcggcggcaaggacatgctgcgggtgatcgaaacctacgccaaccagcccggccgcaaggtcctcaccgaattactggccgcctggaccgccttcgacgaggacgaatacggtcaaagggtgatccgccgctgcagccacagcgaactggcggatcttcgccttgccagcctggacgacgacagcctgcgctgcctgcacctgctggtcctcaaggaggtccatggccgttctctggaagacttgggcagggcgctgaagcggttcgtcaataaccgacacttagatatttcctacgcatgggatgacacgccagcgagatccgccgcattttccactctcatcagccgtatgatgacgtcgaaaaaaagaagccggcgccgcagtcaaaccacaaccgtccttgacgccgcccgcatcgccgcaatcccctcgctccgcagcctggatatcggcgattacgagccgggcgtgttgacagcgatttctggcctgccgaacctgcaggaactggactgttccccgctcgagtcagacgatttggccgtgctggcgaacagccggacactctcggacctgacgctctggggatggtcgagacgaagtcgtgggatgacgggggccaccgtcgatctcagaccactggcacaatgccctgcccttcgggctctgaatctgaggcactttggggacaacgtccccgtcctcctcccggtcggcgccccgctccaacgactggatttgaccttttgtcctccaggcgtctttgaccagctccaacacctttcctccttactcgacctccgcattttttcaaatcacttcccccggtctggactggacctgacgtcccatgcgcaactacgcaaccttgatctcattgccgacacggcgtcactcctgtgccttccgtccagtttggtcgtcctgcggctttcgcacctgaagggactgctattgaccggctcaggtaattttcaggatctggaagatctgacgctcagtagtgtaacgccgttcgacgggctgcaagccctgctcgacgccccaagactgaagagcttgcatatcgacacctcaaccgagaaaaatcttgggccaatactggccaaaatcagacacaggcccggcgtcaccgtccacacgttcaaataacgcctcgcccccacatcaccgccggaacctcaccggctgccttttgcgtccccaggttcccggcgccgcctcgaagcggccgggcagcggggtgccgcagtgccggcaatggccctccggcgtcagggtccaggtggacagctcgtaccagtcccggccgatcagcagggcaccgcagccggagcaataggtgccgccgcccgccgggtcgtggacgttgccggtatagacgtagcgaaggccgttccccagggcgatatcgcgggcccgcgtcagggtggcggggggcgtgttgtccttgtcccgcatcttccagtcgggatggaaggcggagaagtgcagcggcacgtcggggcccagcgcctcgaccatccagcgggtctgggcgtcgatttcctcgggggaatcgttctcgccggggatcagcaaggtggtgacctcgacccacacgccggtctcgtgccggagatagaccagggtctcctttaccgcttccagatgggcgccgcacaggcggtgatagaagtcctcggtgaaggccttgaggtccacgttggcggcatccatgtgggcgtagaactcggcccgggcctcgggcttgatgtagcccgccgtcaccgccacggtcttcaggcccagggcgtggcaggccttggccacgtccacggcgtattccaggaagatgacgggatcgttgtaggtgaaggccaccgagcggcagcccaactgcaccgccgcccgggcgatggtctcgggatcggccatgtcgttgagcttgtcgatctccctcgccttggagatgtcccagttctggctatccttacatattgcatctatttgattttgcgtgatattttcgctcaataactgtgtgtaaactgtgtgtgaatttcgagattcgtaaacaagcgttttcaataagttatcatgctcttttgagatattccaattttgacaaaatttgcaggttaggttgcagccgatgcttcctaaagacaggatcggtgttcccggtagaaaatgatttaaaggcttcttctcaatgggatcgatgcaaaacccactgctgcgcccgtatgtcgtcagaacaatttcatcgtgtattgcagctcggttgaagcagagaccaagctgcccattatggagcttgcactctcggggacacacatcacactggatgcgaccgtcacctagcttcgtccagtacttggttctgcgaaacatttggagacaagctcccgctcggaaagagaggctttgccaccgcaaaagcctaccacaatctgatgccgccctgaccttgaatccgcacttgaatgcgcgcactcaaattcttcaattttgatatcctgttcaaaattttgggaatcacgatgccaagcaagcctcccattacgcctcttcgatggtacggcagcaaacgccgttcgttagatgtgatagatcgctggctgccaccgcatgtgatggaataccgcgagccatttgttggcggtggcgcatccttcctactggctcgtttcaaatacccagacgtgccgttctggatcaacgacaaggatcggcgggtaacaagcttctggacgaccgtgcgcgatatgccggatgccctggaaggcaatatcacaaaccttgtagctcaggcacgcatggcagagacgtctgccgagactctctacgccgagcagttcgctgcacagcaaagcgacaatgtgttggaagctggaacggcctttctcgccattaatatgtggtcgtttaacgcactcatggggccgaaggactttcggtgggattatgtccagaagcagcgcaaagacttgtccccgcgaattcgacaggcccatgccctgctccaaggcgtgaccattaccaacggtgactatgcccctttgctgtccgagccagctaaaggccccagcgatgcgggtgtcgtggctttcatggacccgccctatgacgggacagaatccatctacaaggaaggtgcgggcttcaatttcgacgccttttatgatgcggtgctcgccagcaagcacaattggatcattacccactatttgcgccgcttttggccgcgtgccttcaagctgttctactacggtgaaagccggacctggaaggtagacaccttcctggacggggtggggccaaacaaacgcgatgaacgcctcattgcaaattttgatccttcatcagacctttggagattgtttggcgctcggataaactcggatggaaccattgccatgccgaatcgggctgggggagactgacacatgggattgagcgcgaatcagaccaagctgaaggcggctgccaacggatcatatgtccagagcgttgagctggaggccaacgctgagaagtgcttgaaccaagcgttaacgcaggcatttgccttcggctacacgttcgtcctcgatcaaagcgaattgttcaagctgatccaggatatgggagcaaagccctcccgcagtgacacaagctggtggactgacgtggtgaaggcttgctttggcacaacgagcgcgacccgtaagaacgcctatgacttccccagcgtggcggcaatctccaagtaccagaccattcttgcctatgcccactataagcagtggaacgaggcagcattggacgaggaattatcatcacgctccgcgacggacatttatcgggaagcaggccaatgtcaagagtttgtccaagcgcagggacgcagcaagtcccgatccatggataaagggctgctcaagcgactggatgatgcctgcacgcacacctttgatggaaataccatcaccttatccgaggcagaccttgaagacctgttggtggccaatgacgatggcttgggagctgtgctgattaggcgggaaaacggcaggatcaaactgtggcgagccccccttgatgccacatatatccgtaaagccatcaacgaatacgctacgattgagaaagctcgaaagccgctgactgaggcgttgcggatgcgctccctgcttccaaaaggggttcaacgccatatgcgatttgagcacgaaggcgatgccacaatggtaacgctgttcggggcactggaaggaaccagcgcaattcgcttcaccacctcaaagctggatgtaccccacgcagcaacgtttgatgagaagggaattgatcgcctgcttggactgtccattggagttggcgatgagcggtttacctgggaggttcaggaaggcgtggttaaaatctatgccaaggaccaagaggtcatgccggacccggaagccgtttacaaagtgcttcaggaggaaggcgtggactggagctctcctgacggaaccgagcgcgttgactgctggatcgtagaaactgttccctatccgccgaccgctccaaagttcaattgcgagggtaaggtggagattgacgagaacgtgacgcaaaagctcatggcggaaggggagtggaagggcaagtccaccacaatcagctcctccaatggttcgctacacgcaaaatcctccaaaagccaattgaacgtgcctatcgatggcttgcccaatcacgagccggtaaagcttcttcggggacaagtaggccgggcaatcaaacagctggaaggcgtttcgacgctcggaatatccgaaggtggcgtaatcatcagcggaacccacaaggatttttcggtcacaatcacgattccggccttgagctaagccgtggcctatttcgaggatatcccccaccgtcctcaacgctctatatttacgcccagcgtttctaccacctacttcgataaggtcagcaagaagcggacggaaatacgccaggagaacattccaccgcgcttgaagacgatggaacagctatggtggtggaacaagggcggtgaagctcgccccttctttcactacccctatttcatgtatagcgcaggccatgccgaattggacttggcgaaagccgcgaccaaggaagctgccctgttcaagagggaccgtgcatccagcgttctcattaccgatagcggtggctatcaggtggctaccatcccagatttctttgattgggactcccctgagaaaatcgacaagaagcgtgaacggcttttcaattggatcgatgccgttgccgattattcgttgtcgcttgatgctccaacattcggcgcatcccccgaccataaagccctgaaaagctttgacgactgcttagcattcaccctcgaaaatctggaattttacgaagcacgctccaacaagaacgaaagcgtccgcttcctccacgccattcacggctccacgattgacgaacaaacgaaatggtatgaagccgtaaaaggccatcgccattatggctgggcgtttggagcctccacggaggaaaccccgttccggaaccttaagaacctccttcgaatgctgatgtatctcaagcaggaaggggctttggagcattcacctcatgtccatgtcctgggcatgggggttagcgcagccgctgttatgtactcctatatccaaattatgatgcgccgaagcggcatccccaagtttcaaattaccttcgacgtatccaccgcctttcggaaggctggagaatccggctttttatacacggattttgagcgatccattttgggccgaaatctggaggcaacgagaaaagccactgtccccaaaactggctgggaagactgggaccttccaatggggcatgaagatttgccgaagcaactggacttcgagagccccgtgtttggctatgccgaagacaaagatcgaatcatgcctaaacacctccagccttggagcgatggcatatctctatccctgatgatggcccaaaacctgtggcttcaaacagagatgtacaaagacgcccatgatcgcttcttcaccgcgttggagcgcctgcccattgaaaggggactttcggatcaaacgctggaaaagcttctcctcagcgttgcatcccattttagcaagcataaggaattgaaaagcatccaagagaatgtctggcagatgatgtacctaatccatgctgaaggcatcatgcctccaggctggcgacgtggcgaccgtggcatgtccctggagtatttcatggccatcaagtccatgattgatgatgtgtttgacgccaaaaacccttatgccgtcctcgacaagtatgaggcggagctgagctcttatctgggtggcatggtcgtatcttgatctgccaaatttacctttgcacgagaagataatttcgggtgtggtgattttccaaccgatccatgccaccatgaacccatatccgagcaagcgggggatgcatggcaaaatcaccgacccttatccatcgagagatcggtattgattgcggtcaccgcgttcccgatcacggctcaaaatgccgttctccacacggtcacaggtatcgcgtaatcgccacatgtgcgggccaccttgttcaggactttggccatcctgagcacggcatggtcatcgatttcggcaacgtcaaagcctacatgatggatatcttcgactccatctttgaccacgcattcattgtgagcgccgccgacgccgtaatgatggagatgttctacccaggtgaagacccaagagccattttggctctgtatcagaaatccattgccgaacagttggagttctactgttcaaccgcagacaagaagcctattcggcttcctcgcacctgctacagcgaacaagacccagacggcatgaaggtcgtgcccgttccgtattccccgacggctgagaaccttgcggctcatatgttcgagctgctgggtcagcctttgaaggcgcacttcgagaagacacctattcgcctcgtcaacatccggctgttcgaaacgcccaatggttgggtcgatcacacggctgacggtttcaatccggggattatgggatgagctacaaggtcaaagaaatcttctacagcttgcagggcgaaggggcgcacagcggacggcctgcaatcttttgtcgattttcaaactgcaatctgtggagcggcaaggaagaagatcgggccgatgctgtttgtaaattctgtgacaccgatttcgttggcggtcaggaatacacgattgagggcctggtccaagccatatccgcaaagtggcctggtggaggcaagccgtatgtcatttgcactggtggcgagccgcttcttcaagttgatatcccgctcgttgatgcactgcatgtcgctggctttgaagtcgctgtggaaaccaatggcacagtcggcaagcatgatgtcgcggccaagttggactgggtgtgcgtgagccccaaggctgatgcgcgtgtgaagttggatcgagggcatgagttgaagctggtctacccccagaccgaaaaccatccgtccgactttgaacgaatggcgttcaagcacttcttccttcagccttgtgacggcgttgaaggcagcacggcaatggcaatcgactactgcttggctcacccgcattggagcctgagcctacagacccacaagattggaggcttcgaataacatggccgagaatgatgccgttgacctacctcctgaagctcccgcaaaaaagcctcgaaggaagcctgcccctccgaaggaagctggtggcatcccaatcgtctatagaggaccggaaggctttgtcggcctgaacaagaatgaccgcacaggctcgtgggaggcgatgtgcaagcccgaaggcacgacccggcatgtgacgattacgctcgcggccaagtcagaggaagatgccaagagcgaagctatcttcgcccttaagcacgattcccagcatcgcattcataggcgcccaacgcgagaggatgccatggaggcggtaaagacgcttattgcctactcgggggacaatccatatcgggaaggactccgagggacacctgatcgcgtaattcgagcttacgatgagttcttcgcaggttaccactccaccgctgccgaggtcttgaagaccaccttcgcggaaacgggttcctacgatgagatggtgacgcttacggacatcgagttcgacagccattgtgaacaccacatggtgccgttcaccggggtggtgcacatagcctacattcccgacaagacagtggtcgggatcagcaagttggcccggcttgtggagatttacgcacggcggctgcaaattcaggaaaagatgacgacgcaaatcgccgataagcttcacatggctttgaagcccaagggcgttgccgtggttatcgcaggccagcacatgtgcatgaccacgcgaggcgtcaaaaagaagcgggtcaagatgataaccagcaccatgacgggcgtgttccgagaggacccaaaggttcgctcggaatttatgaatttgattgggaatccgaaaggtgggatggaaaaatgagcgaatagtggctctgcgctcagctcagctggctaagaggttgccaattcggactgtgcgtgtagccggttatatgatttagagctctaaatgcgaggggcttggcgaaagccgagaggaaaaatgaaactcgaaaaaattatcattaagggttttaaaaaaattcaccgacttgagttgagccttgaagatattaatcttctgattgggggaaacaattctggaaaaagcagtacgctccaggcggtacatgcagctgtaactgcagctcaatctcagcttgagttcggaaatacgcaaacagtctccgagcaaaaattgcgctactcacctacaggggattactcccaacttgggcacaagagtccatttggcaatagggccgatcaaaatcgcgctgaaattcaatttattggtaaaagttcttctggtgacgctgctgagtatacaatcgaactttacaaaggacggaacgagggcaatgtaggtatcagccggtctggtacctaccctaattacggagctaacatttgccgagttgccccaccttttactgtttatgtccctggattggcaggcgttccgcatcaagaagaatttaaaactgaggccgtcgtgttgagaaaaatggccggcggcgaagccaattttgtattacgcaatatcttgttgatgctgtcgaaacaaggaaagctaccggaacttactggcttgttggagaagctctttggacccattgatattgacgttacctttaggcctgagcgtgaccatcacataagcgttaaagtttctgttggatctggtgaataccccgttccgttagaccttgtagggacaggcctacttcaggccattcaaatatttgcatacgtaacgctcttctctcctgctctgcttctacttgacgagccagactcacacctgcatccttcgaaccaatctatgctaatgcaggcatttagaataattgctagcaattttgatacaaagattcttattgccacacatagccgacatcttattttatcagctccagaagatgccaaatgtttttggctggatggcgggatgctgcgaaacgagcgcgaatatgaggcgattgacttgttaacggaacttggcgctttggatgatgccgataaggttttgaactcccaaaaagaattcctttttattgttgaggatgaaaaccctgacattttaaagtttttgctgcagaacataggcattggaagagagcgatacgacatagttccgtactatggcacctctcatgctgaagcgattgcaaagaccctaaaaaagctgaagcgccttatacgtggcaacagaaaccttatactgcatcgtgatcgcgactttatgaccgatgctgaggttgaaacgtggaaacgcaaggttggcgttcccggcgtcaccatcttcgttacgcagggctctgatcttgagcactacttaattaacgccaatcacttgagttcaatttcaggcttgaatgtcgatatcgtaagcaatcttattgatacactattgtctgaaggagacggaaaaatcagaaaatcttttaaaaacaaaaggaaatcagtgaaccatgatttgcatgaagacggcggcggcccgttgaccgatgatctttgccctccagatcaaaacgtttgccttgatcacgtcatcggcaaattttttgaaatcgccgtcaaaaatgaatcggaacgaatcacaggcaaaaaaataattccccgcagtcaatcgggtgttgttttggccccagacctaaaaattcttctggaagcgttgcggggctaagccaactcagccgccttcaccatcatctcttcattgactgtgacgtaacgctgggtggtttggatgctttggtgtccggcaagctgttgcagcacaaacacggaaacacccttgttcgccagcgtcgttaaatacgaacgacgaccactgtgagaacgcgcatccgacaaacccgcttcgtcgtaaatgcggcggaacagcatgaccattgtggtcggcgagaagtgtccgcccttttggctgcggatcagcggcttgcgttcgtccgtccattcccgctgttcaagatagcgagcgatctcgcgctggagcttggtgttgatgaacaccgtgcgtccgcgcttccccttggtttgggtggctgcgagatggacgcgatcacggacagcgccgccttcattaactacgtccataattttcaaggcggcgatttcaccagcccgcatgcccgcccaatgggacagcaaaacagcaaggcgattacgggtggaaaggatgccgtgctgggcgaccacagccaggacgcgcttcatctcggcttcggacaggactttggcttgcgacatgacgaacacccataatgttatgttttcatcctatgggtagtgtcacatcaccttttgccaaggtctccccgatatcgggctttggaaaccgcagaaatcggcgcttggttatggttttgctattccataacgtccgatacgggattggcgtggctgagtattcacgctcaagccgtttgataagtattttaatatcggcttttggtgtcttaatggcgcattttgtgacacccctttatagaaggcgggatatgatctaaggtatatatctggtattggatttgattttgggaggagggggtggggctccccgaaatccgcttggcggttaattctgtgtctgcattccgccggctcgtgatgggctcggcggtgctgtggacgtttgccgttgccctctccttttggatagggcagcaggccgagcaccggcaggccattgacatggcgatcaatgaagcgcgggtcagcgccaagatcagcattggtttcaggcaatgggccgcttcccatggcggcgtctatgtgcccccaaccgaccggacgccgccgaatagttttcttcaggttccccatcgtgacgtcgaaaccaaggatgggcagcgccttaccttggtcaatccggcatacatgatgcggcagttgatggagcagggatatgtggcaaatgggcgaatcacaagccttaagcccttgaaccctgcaaacgctccggatgcctgggaaaaagctgctttgatgagactggccgctggcgaggtcgaggttaccgagttggtcgcacccgacaaggtgcgcgtgatgcttccgatcatgacagaagaggggtgcctcagttgtcatggtcatcaaggatatgcagttggcgacctcaggggcggggtggacgttgtcgctcaccttggtcctcatcggatgatggcggaagaaagtatccggaggcttgccgtcgaacatctgcttttctggagttttgtgatgatcggcatcactgcggtatggcgagccggccatcatcacgtccgggaaaaagccaggattgagggagggctgcgcctgacccaattcgcgatcgatcgggcagctgacgccgtcttctggttggaccgggatggagagttcttctacgtcaatgacgccgcatgccagttgcttgggtatacccgtgtcgaactacaggaaatgcgtgtctctgacctgaaccccaatcatgtgggcgatgcatgggatgcccactggcgtgaactcaaggaaaagaaggctctgcgtttccagacccaacttctacaaaagaacggggttctgatccccgtagagatcaccgccaactatcatctctgcgatggcaaggagatcgatgtcggtttcgtccgcgacatacgcgaccataaggcctacgaggaggccattgtcggcctcaagaatgtctatgcggccttgagccagaccaaccacaccattctgcacacacgggatcgacaggccatctttgatgccgtcacacgcatcgccgtcgagttcggtcatttccaattggcatggatcggtcttatcgatgcaaagggtaaatcggttcatcccatcgcgtttgccggtgaatccggaaattatctggaaaaccttcagatatcattggagccaggagcgcccacatcggaggggccgacagcccgcagtattctctctggcgagcctatggtggtcgatgacttcctggaatttccgggcacccgcccatggcacgacaaagcccgagaggccggatttcgctcgtcggcgtcctttccaatcttcaatcagggaaaggctatcggcggcctgaacctatacgcgggacaactcgccgctttttccccggatttgatagacctgctcacacagatggcagatgagatatcgtttgggcttgatcgcctggaccttgaggcgagccatcaccggcaggaacaggacctgcgcgatctgattgatcggctgaccgaatccaatgccgaacttgaacgctttgcctttgtggcgtcccatgacctgcgggagcctctcaggaccattgtgtcattcacccagcttatccagaagaatatggcggaaagactgccgaccgaagaacgggagaatttcgtattcgtcatcgatgcagccaagcgcatgaacttgctgatccacgacttgctagctgtatcgagggtgtcgagcaaggatgttggctacgaacggctttcgctgggcgatgcctgcttctcggcaatgaagaaccttcatgaaagtatcagcgagagcggggcggaaatcgagtgttcagagcttccagaggtcatgggtgattttgtgcagatgatgcagattttccagaacctgctgggaaatgcgatcaagttccaggtacctcaccgcaagccgcacatcgtgatttcatcggcgaaagccggtggcttctggacgatccgtgtccaggacaatggcatcggcattgccgataccagccaggatatatttgaacttttccgtcgcttgcatcccagccacgcctatccggggagcggtattggtctcgccgtttgcaagcgtatcatcacgcgccatggtggccggatatgggtcgagccccatgatggagatggcacaacattttgcttcactctgcctgaaatcgagggctgacacctacatcacatgatgtagtctatctataacgaagggtggggcgtgctattggctgaaatttggtggtgggttatgctgccgccttgcgtacctaatctgggaaagggatcgtatcgtgtcgcttggaaacttgaagattgccgcccgcctgatggtgggatttggcctcctggtggttctcatcgccagcctgagcggctatgccgtccattccggcagggccaacctcgaatcggtcgggaatgtctttagttttctcgacaacggagcgctgatggagcgaatcgacaagcggatgttcagcggtcggatgcagctctggatcgccctagcgaccggtgagccgacctattgggaaaagtccgatgcggattttgcccggtcccgcgagaatctaaagaaactgatcgagaatacctcccaccctgaacgacgggccaaggccgaggctgtcagccgcgattttgaggaatacctggtcaaagtcgccaagcttcgcaccatcggcggcaagaacccagcccttgagacgcccgaagcgaaggctctggctgccgatgtcatgtccgccagggtcaagctcgatgaaaaggccgaatctctgacaacggagtatcgccaggcggggaccgagcagggagaggttgctgtcaagtccatcaaccggggcatcgacctctcgatcctggtcggcgcgatcagtgtcgttattgggatggtcttggctttcttcatcagccgctccatcaccaacccggtaaacgccatgacacgggccatgggcgttctggccggaggcgacacctcggtggaaatcccagccaccggccagaaggacgagatcggcgagatggcccatgcggtgcaggtgttcaaggacaacgccatacgggtcaaggccatgcagaaggagcaggaggatgccaaggcccgtgccgaggccgagcgcaagcaagccatgctgaatatggccgacagcttcgagtccgccgtcatggggctggtgaagggagtctcagctcaggcgtcggagatgcaggcgacctcgcagagcatgtcggccggtgcccagcagacctcggcccaggcggctaccgtcgccgccgccgcccaggaggcgaccgccaacgtccagactgtcgccgccgctgccgaggaactgtcatcctccatctcggagatttcccggcaggttgccgaggcggcccaggtttccgccaccgcgtcggaggaaacggcgcggaccaatgccatggtgcagggacttgcccatgccgccgacaagatcggggaagtggtcagcctgatcaatgatatcgccgcgcaaaccaacctgctggccttgaacgccaccatcgaggcggccagggccggtgacgcggggaagggcttcgccgtggtggccaacgaggtgaagaaccttgccaaccaaacggcgcgggccaccgaggagatttcctcgcaggtcggttctgtgcaggaggagacccgccgcgcagtggatgccatccgcaatatcgccacggtcatcgagcaggtgcagcagatttcctccggcatcgcctccgcagtggaagagcagggcgccgccaccgccgaaatcgcccgcaatgtccaggaagccgctaaagggacgcaggacgtatcggcgaatgtccaaggcatcacccagaccgcctcggaaaccggtgcggcgtcgcagcaggtgctggccgcgtcgggtgaactcgcccgaaactcggagacccttcgggccgaggttgataaattccttgatggcgtgcgggcaggttaaacggggcgcgccatctggaggcggctggcctggccgtcggtcgcctccctccctctctcctaaatgaatatggcgcgggctgcattttgttgggcgggctggaatgtcacagaatgcaagaatactgatcattgacgacaacgttgcggaagcgacgctgacgaggctgacgctgcaggcgggcaggattggctgtagcattgagcatgtgacggacggctacacgggtattgataggttgaaagaggctgtgcagacgacgcggccatacgacatggtcatactcgatgtaaatatgccgcttatcagcggatgtgagacacttgaaataatacgggacacggcttatattgcggaaatctatgtggcgatcttgacaagcttgcgatgcggaacagattgcccgcgcgatttatatctgtgtagcatgaagaaggctgacatatatttgcaaaaggaaatgatacttgacgactttaatgcagagattttacggctaaaggctgaatacgacagaagaaggaagtcacggagacccacgactgaatccagggatatataggtgcgctttctggcgttaaaatgtgccccagcctgactgagaggcattgagcggcttccgagacgggggcactgccgataccaaagggtccttgatgcctccgacaagatcaggccgagcagccttgtcgcgggcagagttactgcggtaatgagattttgagcatgcaagagtccgcgaaacgttgtcaggcatggatttcagaacagcgcagacccatgcgcgatcattacgaagtctgcccctttcgctccctggcaagctcgttcgccaaggagaaggatgaaatcctgtttcatgctggcgacactctggcggggggatacagcctgacctccggcctggttgcgttggagcgcgccagcccgcaaggcaagctggtaatcttcaagatactctatcccggagctttcttccccctgtccaacatcctgtcggacggcgtctgcaccaccacggcccgcgccctgtccgacgtgaggttctgcttcatcaccatcgaccgcctgaggcagtccatggagcgggataaccgcatctcgctatctctgctcaagatgagcgccatggagatgttggacaacgaaaacgccctgttcggggtgagcggcgtgccgctgcaagagagggtgctgtctctgctatgcgccgtgggactgcaggtcgggaggcgcgaccggaccggtgatctggattttaccttgccgttctcctgggccgatctggccgccctgtcaggaacggggccggaagtcctgtcgcgcctgctgcgtcgcctcaagaatgccggtcgcctcgacttccagcggcggcagatccgtatccctgcggatgaattattggaagcatccggaacttaagccgtctcagccccatcttgggcaatttcttagcatgagaggatttgggccctctcccggcaggcatccagaatggctcttccaagcgggagctccaattcctgaggcaattccatcgatggctgccactgcccatccggtgttcgatgggccggaagccgcacctgtaggcaatcgccatagctggccttggccttgatgaccgggacgccatggatggtcatcacgatgccgtcaatgtcgagttcgaccgaggctagtgccatcaccttcgacgaaaaaaccgggtggatcgccaagacgcggcatccgatcagccctgtttcgactgaaggctccgccgagggctggatgtcgttcattgagcggtctggatgcctccggatacttcagcaaaccggccaaagacgttgccgtgcctttggccggaatcacaggagggtgctgaaatttggcataagccataagcaaactgccaaacagctattcatgtgtcaattcatttgcggcgcatcggttgccttgaggggcgaacagttgtatctgatggcagtatcctgcagccgttatagccctcgcatgagccggggatttcacgaggatcatgatgcggatcgtcgcttcggatgaagaccagcttaccgtgatcaccgagacgttcaggttactgggcgatcccacccggttgaaaatcctcctcgcctgcctttccgaacccaaatgcgtcaacgacgtcgccagcgaggtcggcattactggatcactgaccagccaccacctgcgcctgctgcggggcgcgcggttggtgcgtgccgagcggcaggggcggcaaatcttctacgtggcggcggacagccatgtgaacgccatgctggccgagatggtggcgcatatccgccagcccgccgaagacgaggacgacacctgaaaatacatccaggatgcatgaagattgcattgcacccagacatatgaacacttattttgatgttcagtcgttctaaccaagctgttgaatgaggcggtgcggctccgtggagtgggggatattcaggcgtaagaccgagatcatcgaggtcggcgatctgttcaggaaggtcgatgacaatcttggccgggtatgggaggtcacccgtctgtgggtgacggtggatggtctgcttcatgcccgcttggtggtgctgggtgattccggcgagtcgatcatcgtttccaccatggcccttgctgataacgggcactttcgttccgtcctgccgtcattggacgaatgagtgaaaggcccacgtttatgcccgcccggttgatcaacctgttcacgccgaaattgctcgtctgcttgaaggagggctatgaccttcctcggggacgtggcgacctgatcgccggtttgacggtggccattgtcgccctgccgttggccatggccctgggaattgcctcgggcgtcactcccgaccgtggattgttcaccgccatcgtcgccggcttcctgatttcgttcctggggggaagccgcttccagatcggcggaccgaccggcgcgttcgtggtcgtcgtctacaacatcgtgcagcagcacggttatgacgggctggtgctcgccaccttaatggctggtgtgatgctcctgctcttcggtctcgcccgcttcggcgtcgtcatcaaatatatcccctatccgctggtgactggcttcacctcgggaattgcggtcatcatcttttccagccaagtgaaggacttcctcggcctgcggatggagagcgtcccggcggagtttttcgagaaatgggttgcctatggcgagcatatcggcaccactcatgggccgaccttggcggtggccgccgggacgctggcggtgatcctggtgctgcggcggttccggcccggctggccaggatttctgatcggggttaccggcgcatcggttttggtctgggcgctgggaatgccggtggaaaccatcggcagccggtttggcggcattccctcgaccctgccatcgccccaatttcccgccttgtcctggggcaaggtgactgcgttgttacagccggccttcaccatcgcctttctggccgggatcgagtcgctgctttcggccatggtcgccgatggcatgaccggccggcggcacaagtccaattgcgaattgctggcccagggcatcgccaatatcgcctcggtcctgttcggcggcattccggcgaccggtgccatcgccaggacggccaccagcatcaagtccggggcgcagacccccgtggcagggatgctgcatgccgtctttatcttgctgttcatgctgctgttcgcgccgctggctagctggattccccttcccagcctcgccgccgtgctgatggtggtggcgtggaacatgagcgaggccccccacttcatccacctgatgtccgccccccgaagcgaccgggcggtgctgctcgtcacctttgttctcacggtgatggtcgatctgaccgtcgccattgaggtcggcatggtgctggcgtcgatcctgttcatgcgccgcatggccgaggttaccgagatcggcaccggtattcacctgatcgacgaggatgccgaggacggcggcgacgaccatgtgggcgccatcccgaccaccccgattcccgatggcgtcgaagtcttccagatcagcggcccgttcttcttcggggtcgccacccgcttgagcgaagtgttcgagcagacccacaagccgcccagggtgttcatcctccggatgcgcctggttccggtgattgatgccagtggtatccaggcgctcacggaattcgtccggcgatgccgcaagcacggcaccgaggtcctgctgtcgggggtccagcctcagccaatgcaggtgatgggacgcatggggctttgccacgaaattggtgaggacaacttcgtgcccaacatcgatgccgctctgacgacggcacgcaccctggccgtccacccctgacctcgatcaccatggagtacgaaatgcgcgatatctctgccatagcgagatcacactcccgcatcctggtcgtatcgccaaaccagcagaagctcgaaatgctgaagaggcagttgcaaaatatcgggtttgcccagatcgactgggacgacaaccccagtctggcaatcggcaagttcagccatgcgtcgtatgacacggtcttcgtggatggcaccctgccgaagcgagacatcaaggccatatccgagatcgtccatatcactcttggccgtccgcgagccaagctgattctgatgaccgagaaggggggcgagggagcaagcaagagcgccgccgatgggtatgacgcaaccatcaagactcaggtgagcgtcttcgatctgcggaagctcttcatcagcctgttcggatgaacaagtctgaagcttcaatcaagaagatgctgagaagaggctttcgctttaaccggaatgtcatctcggagacattggcatcattctgttccatcgtagcctttcctggccgagagggaacaaaaagggcacatttgatctgccaagtacataaatagccctccaggccaacgaaacatctttatatctgtttaggagttaagccggccttgaaatatgcattaggtatgcgcaatattgagtttctggttaggcgaaatggcattcagagatatgacaatggtcaagcgtgttctggtggttgatgattccaagacgcaacgaatgatcatgatgcgtgccttggccgagttcagctgtgaaatcgtcggagaggccgaggatggtcagcaggctaccgagatggcagcgcgattgtcgcccgatgtcattttcttggacatggagatgccggggatgactgggcttcaagccttaaaagccatcaaggcggtcaaccccaagattgtgatcttcatggtcacctccatcgattcctcagatgtcatcgacgattgcattatggccggtgctgaagactacatccgcaaggaccggttggagacgctccgagccagggccgggggcttcctgaaatagtctcgcgagattgaagttagtggggtgtgctttgccgcagtcaaccagcatttcaaccgattacgaccgccccattgagatcgccaagggcgtgttctgggtcggcttcacggacagcgagggccgcctgcaatgcaacccctatctgatcgtcgatggtgacgaggccattctaatcgatggcggcagcaggccggatttcagcacagtcatgcgcaaggtgcttcagaccggcatcaggccgaaccagatcagccatttgatctaccagcactatgatccagatctctgcgggtcgatccccaatctggaggccatcatcgacagccccgacctcaaggtgctgtccaagcgggagaacaaccccttcatcaaccactatgcgattcactccccactgctgtgtattgatcggctcggacgagtattaaagatgcgctcggggcgccaattgcgtttttttccaacaccttactcacattcggcaggcagtttcgtcacctatgacgagacgaccggcgtactgttttccagcgatctgttcggggctgccggggcattgtcacgctggaaattgttcggcgacttcgagcatatctgccagacctgcaagcgcattccgcccgatgagatcgaaacggactgtggcgagactggcgatccctgtccatggacgccgatgtacggtttccaccgcgaaatcatgacctgcaacaaggcgcttcgattcgcgctctcagtgatcaggccaattgcccccaacgtgatcgccccccagcacggctcaatcctgcggacgcccaaggatatacaagccgccattgagcggctggagcaactggatgtcgggatcgataaccttccccaggccgccgctttcggctgattgaggcgccaagatgtggaactcggacgaaattgatttcgcagaagccgcccagtcccatggcacactggtatcgtgcatgctggaatatcaggcgatgctagccgaccggcacctcaacgaggtgctgctgggcgaactggtcgatcaattcgttcattcggagcagcggctggccgaggctcatgccgccgttctggcgctgtcccgtacagatgggctcaccggcatcgccaatcggcgctggttcgacgaatcgctggcccatgaatttgcacgggccttgcggtccaagacgccgatcggcctgctgctcctggatatcgactgcttcaagctcttcaatgacaattacggtcatgcggccggagatgactgtctgcgcaaggttgcccaggctgtgcggtcggtggtgaaaagacctcccgacatgaccgcgcgatatggcggcgaggaaatcgtctgtctgctgcccgataccggtctggatggcgtattcagggtcggaaatgccgtgcttgacgctgttcgcgctctggatattccccatcgattttccaaggcgaccgatatcgtcacggttagcatcggtggggtgtcgatcatccccgcccaggatatgacgccgaccaacatcatcgaggcagccgacagccatctttaccaatccaaggagcatggccgcaatcggctgaccatgccctcactgtaaagccccctgccaagcgccagcttgagtcgcgccagcatatcgacggaggacggaatggctccacccaatacatcgctgaccggacgtgaacgcaccttcaaggacggcgagatcatcgtcagcaagaccgatccacagggaaagctggtctacgtcaacgatgtcttcctggacgtgagcggcttcgaggagcatgagcttctgggcaagccccactcgatcatccgccatcccgaaatgccccggtgcatcttcaagctgctgtgggacaccatttccagcggcaacgagctgttcgcctatgtgaacaaccgggcgaaaaacggtgacaattactgggttctggcccatgtcaccccgaattttgatgccagcggttcctccattatcggctaccactccaatcggcgagttcccgagcgcaaggcgctccaggctatcgagccgctgtacaagcgtcttcttgccgaagaacagaagcatggcgaccgcaaggccggtctgcaggcatcctgggccatgctcaacgctgccgtgtcgcaggcggggttcgatgcctacgaccgtttcattttcagtgtcatcaacggttagggggacgccatgctgcccaatatcgatagtcgtcaggcatcgtccctgttgatcgtgatcgtgatcgccttgacggttctggcgatcatttccctgacgggcggtccactcggtggtcttcaatggatggaattgatcctttgcctcgttctggggggagccggactgctcattggtgccagcctgcgggtcagggtcggcaagaccgcagaattcgttgatcgggcgacccgcgtcgttgccgccgccgcccagggggatctgaacgcccgcatcaccaacatcgaccgccgtcaccccatcgcgtcattgctgagcggcatcaaccgtgtgctcgacctctcggaagccttcgccaaggaggccaacactgcgatgcagtacgcaaatcagcggaagtatttccgtaccattctgaccaaggggctgcggggagatttcgtgaccttcgccaccaccatcaaccggtctttggcgatgatggagaccaatgagaaggcatttgtagccttcgcagaggagaaggttcgaccggttgctcgggcggttggaggagcctcgtcggcgctggcggataatgcctccaacctgtcggcccaggcatcggatacctcgcaacaggccatgacagtcgcggcagcggcggagcaggcttcggttaatgtgcaggctgtcgcttcagcggtcgaggaattttcggcttcgatccgcgaaatcacccaacaggtcaatcgcgctgcctctacggcccaggaagccagcggtaaggtagagcaaaccaattcagtggtgcagacccttggcaatgctgctcagcgtatcggcgacgtggtcagtctaatccaggatatcgccagccagaccaacctgctggcgctgaacgccaccatcgaggcggcccgtgccggcgaggccggcaagggctttgccgtggtggccaatgaggtgaagaaccttgccaaccagacagccagagcgaccgaggacattacacagcaggtttcgcaaatccaggacgcgactaaggaggccgttcaggccatgtccgaaatcggcgtgacggtggctcagatcgaggaaacgtccgccgccgtggccggtgcggtggaagaacagaatgctgtcacccaggaaattgcccgcaatgtagctgaagcggctaccggcacccagtcggtatcggaggccatctctctggttcaggcggcggctaaaaacgccttggacggagccgccgaggtctcgcactcctcccaatccatgtcacgggactcctccaacctgatcgagaacatcgactcgttcctcgataggctgcgagcgtaagaagttatttcaaggcgccatacgtggtgaaaatggctaaatacccttaaaccgagggtatcaacatgcgtctttacgaaatcatccaaacaccactgtccgccgatctgtcctatgacgtgaaattcaacaggctgaaagtgcgtaagaagccgagccggtctgtcgatcacgaaaatggacgtgttgtgaccatacccaaccagcccccaaagctgacattgaagcacgtccacagaatgaagctgttgcgacagcgttacctggaaacacagcaaaagctgacagcatttcgtgggttgatgtatggggggcatgcacatgccgagcaacttgatctcggaaacatgcaatcccgcatatctcggcatgaaaagctacaggccaagctggacgacatggctatgcgttatgtgaaaaggacgatttgaggtcgtccttttcgttgcttgtcaaaccgtcacgtccactcgccaaatccgcttgatgcccaaatggcgcattttgaggagcaggatgtttttctcgggcaaatggcccaggtaatagctgctgctggcatattggtcgggatcaacctcatgaccgaacatccccattagctctcgcttataaattggacaccacgttttcttgtatccgcgaggaaccacttcatccatgaactccttgtggaagcgcactgcggtaaattcaatgaggtagccgtaactttccttggatttcatagtggcgccctcccatatggtgcggcttgggagccaagttcagcttgaaatttattggatacaatcccatcaacctgtgctgcctgcggcttgcgaacgccgctgattcccaaggcgttgtagtcgtcctgccaaacgtgggtgttgcggcgattgcctcctcggttgagctcccggcacatcaaccactgaatgctgagttcgtcgtcccaactgacaaagatcagctcaggcaaactgcctgccggatcaagcaagcacgtccatcgcggtatgtgctggccatacagcttgggtttgaagtcagcgagcaccatgtaatcagcgtcgcgctcaccgttgatttgcgggattttgtccatcagctcggctgtgacgtgagctggggcgctggtttgcaggtaccaatgatccggagtgtggaaatttagataaaaagcttcaacggcatcaacctcaacagatatgctgtagcctttgtggaattttgagccctttttggggttcgtgttgtaccaaagtttgaatatttgtttcattacatttgcctccttgtaattcaaacgtggaaaagggcgacgctggaaacgtcgcccttggtttgattaactggcaggcaatgaaactggccttgctggcacttgtatttatctgtgaatgcaattccgcatgcatgaaatctgcgggttgagctgaaattttatcaacacattcacgtcctgtgttcccgtcgcgtgttcctgtcatgtgttccgaaggaacatcccgtagggaagcgtcatgtgtttgtcgtcgtgtgtttatccatgaggcccaggcctgcaccaaggcagagtggtgggctccaaacacccgactttgggcttccgccctattcaacacatgacgaacacgcgactgaacatctgacgtaaattgctctttgaaataaattaaattcatttccttatccagttaatcaagcaggtcaatgcgctatcttcaacactagacatcccataaaggcacgtcgactgaaccacactgacctacatgtatatttagctttcgatgcgggaattaggccaattgaattcgctatgatcagcattattttgggatttcgggaagatggtggccaattggccacctttaaacccatgtatggagccggttaggctgatatctctaaaattatcttcacgcatgaagataattccctttcaggggagacccatgaatccaattgggtgacgttagctccagtgcaatcacgccctggaggcaatcatgtccatcaagaacctcgaattttccaccattgctccgcccaaggtttcgcggaatgcgatgaataccaagacccgtgcccgctccaagttcatcgccgccgtggtcaatcagatcggtgccgttgaagcggcgatttcgggtaagagcttcgccgtccagaaggtgcgtcgcatcacgggtgaagatggatcgcaccgtcaggtaagccatgatgtgcaggtgcgaccctggtggttcctccagggtgatgttttctatctggctcccaagtatgccaatcagccgctgacgctcggtgcgaacaagtccaagcccacagtggtgtgcggcaagagcctgtccgatgtggccgccacgctgaacaccgtcaaggctgccgctgaagcgggtgagctggatgatgtgctcgaagcccaggcaatcaccgctcgtaagcgaatgactaagaagtagaggaaccatagggggcttcggcccccttttctttttggagccatcgcatgcaacgcatccgaatcatccgcgaattgaatgatcagctccgacagtatggcatcggcggcaaggtctacatcacatccggcatacaggcccttgaggagtggctgggccgcgccattatcaccaccgtccgtgagttcgatcaattcgatcaaagcaacgatccatatggcgagcatgacatgggtgcggtggatgtagcaggtacaaaggccatgtggaaaatcgactactacgatccgtcgattacctacgccagcgatgatcctgctgatccgcaaaaaaccgttcgcgtgctcacgatcatgctcgccgatgaatattgaatagtgccaaaagagcagatcagaaaattttaatacttaaaattcatgaagcgccgctgttgcggcgttttgtgctttcaccggacagggcatccctgccgcatagcctcgctcaaaaacgcgttttaacgctcatacaacgcgatttgcgaagggcccgccgcccaactagcataaatcgacaacgccgctgtgcgagcggaaaatcgcgcgaactcgaaatctgcgggcgccagctagcgatgaggcatcaaggcaaatgccaggcacttgcaaagctgctgcacttattttcgggtacggacatctggaacgtcattttcgattcgaatgaagtattcgccatccttcggtgaacctccagccttcttgtccaccttttgccgcctgactagcaccggtgcagttttctctttattgacccgtgtgatcatgcgtgcctggaagctatccaagccttccgggatattcttccttacggaagtgagcacagtggctttttgcatattagagacatgaccatagtgcttctcgatcatctccacgctggttcccatgttttttgccagcgtgtaagcatccacattatccccatacaataggcggaaggtcgcgtaggtgtgcctgaaggaataggctgaaaatttcctgccgaatctgtcatgggttattttcgaaaactcaaaagctttttcgacaggcctctctattgcgcctaactgcgtaccgttaaaattgcaaaacacccatgaatctggctcacaaggcaattgatgtttcttttgaaatcggatcaattcctcaaccacactccagcacacaggcattgggacggtatccctctcaccggtctttctcgcgggattgacgtgtatgacaagttgattttggccgttttcgtccttaaatgcggaaaagtccctccaccgcaaggtcttggcctctagcggccgaagtccactatgcactagcaactcacaaaaaaggcgagccatcgtgcgggggacaaagtgctgtgggcgaggcgattcccgttcccattctttggctttctttagaaatttgacccactgcgggtgttccagagctgggcggcgatttctttccagctttaccgggacctcaagctgtggcttgcgggcaataaacttattgcgctccgcccacttgaaaaattgggaaagcgcatctttttcggcatacagcaatgccgaggatggctcgaccgcaaccttacctgaaagacgctgaagttcgtccgaatgactgcgccagtaattaatcctccagctccaatatttttccacatacaggtcatcaatgagatcgaatgccctttcatcgaaatactcgaagaaatacctccgggcaaatccctcgaatgttttaatcctattttgcgtatagtacacgcctcgctcatccagccatttcttccagattcggctgaatttgtgcctcccgtaaggaatgccgtgtctctctttgatctccacttctcgctttaagtcccttgccgcacttaaagcctcagccagatcattgtggcgcgtactttttacaagccaatcccctttgggagttttaatccgcgcttgccacggcccgttcaccgtatcggtgcgccggtagagcagtatgtcgccattttcgaatgaatgtttttccggggatacgacttggtgctcagccagaacttcaaaactgtaaagctcaagagcgaatgccttggcgacatcaatgtcactagacttggtggagcgccgcaatgaggccccaccctttaagcgaagcttgcactgccatacgccgcgcttgctagcatccggacgcctgtaaagcgttatctcaccatcgtttagaacgacctgctccatccccgtcccgcacacctgtgtcaaaaactgtgttggcgcaaaacgagcatattggatctgactgaattttcaaagataaatctgtgtgtaaaactgtgtgttaaaatttttatccacacacagatttcataacacactgatattcatggattttatatgtaaataatcatctgtcaggattttctggcagaacttgcaggtcaggttgcagcccgccgtgccgaaggacaggatgggcgtgccgggcaggaagtgattgagcggcttcttctcgacgggatcgacgcagaacccggacgagcggccataggtggtcagcaccatcgctccgccatcattggcccgcacgaaacagagccccctctggccgtcgttcagcttgcactcgcgcgggcagacgtcgcactgcacccgcccatcgtcgagggcatgccagtagcgtcccggaaagtgtgaaccctggatggcgtcgttcatgggggaagagtaccatatcggcgtcacattttcgcgcccgaggccgccatgaccgccatccgccccaccgccgtggcaggacagttctatcccgccgatttcgccgaggccaaccggcagctcaccgcctttctcgacggcgcggtcgccgcgccttgcgccgggcgtcggccaaaggcgctgatcgcgccgcatgccggctgggtctattccggcccggtggcggcgggggcctatgccctgctgaagcccttccggggcagctggtcccgcgtggtgctgctgggccccagccaccgggtggcgttccagggcatggcgctgtcctcggcggaccagtgggcctcgccgctgggcgccgtgcccctggacaaggactggtcgcgcctcgcgggcgtggccggggtaggcgtgctggatcaggcccatgcccaggagcattccctggaggtgcacgtccccttcctgcaggccaccatcggcgagttcaccctgctgccggtagtgatcggcgattcctcgcccgagatggtggccgggctgctggaggccctgtggggcggtgacgagacgctgatcgtcatctccaccgacctctcccactatctgccctacgagcaatgccgcagcaccgacggccagaccgtcgccgccatcgagcacatggatgccgccgccctgtcccgcgacggcgcctgcggccgtcttccggtgggcgggctgctgaccgccgccaagcgccgggggctggagatcgtcaccctggacgtgcgcaattccggcgataccgccgggccgaaggaccgggtggtgggttacggcgcctgggccctgtttgagacggagacacgcatgagcgacgccgaccagatcaaggccgtgggccagaccctgctggaactgtcctgggcctccatccgccacgggctggagaccggaagccccgccgccccgcccgccgagcgtcccggcattctggggcagcccggcgcggtgttcgtcaccctgaaccgccagggaggcttgcgcggctgcatcggttcggtgatcgcctggcgccccctggccgaggatttggtggacaacgccttcaaatccgccttcaaggacccgcgctttccgcccttgacccccgaggagctggaggggctttccctgtcgctctccgtcctcacgccccccgtccccatgagtttccgcgacgaggcccacatgctggagcaattgcggccgcgcaccgacggcctgatcatcgaggatggcggaaggcgcgccctgttcctgccctcggtgtgggagcagttgcccgacaagcatgccttcctggcccacctcaaggccaaggccggcatgccccccggccactggtcgccaagcttcaaggcctcgcgcttccaggcggtggagatcggcaagtgagccccccgcctgtcatcccgagcgtagccgagggatctccacccggcgcgacggggccagatcgggcaagccttgccagaatgcgatccctcctcccgatggtcgtcgggatgatagccacggtggcgccatgaagcgcttcggcttcggccaaagccgcacccgggtcgaagacctgcgcttcctcaccgggggcgggtgctataccgacgacatcaacctgaccggtcagtcatacggcatggtggtgcgctcgctgctgccccatgccgatgtgacggtggatgcggtggcggcgcgggccatgcccggcgtgctgctggtcctcaccgcggccgagatggccgaacagggcatcggccccatggtctgcggcttcctgcccgaggacgcggtgccccggcacccccgcccggtcatcgccggtccccgcacccgccacgcgggcgagcccctggccttcgtggtggccgagaccctggcccaggcccgcgatgccgccgaggcggtgctggtggactaccatcccttacccgccacgccccacgacgcctttgtctgggagatgggcgacgcgtcccgggtggccgaggccttcgcccgggccgccagggtggtggaacttgacctgatcaacaaccgcctggctcccaccgccatggaaccgcgggcctgcctggcccggcccttgcccggcgggcggctggaactgaccgccggcagccagggcgtgcacgagatcagggaccgcctcgcccccgtcctcggcatcgccgccgaccgcctggacgtcatcacccccgatgtgggcggcggcttcgggctcaagatcagccccttcccggaacaggccatggcgctggtggcggcgcggattctcgaccgaccggtcaagtggaccggcgaccgcaccgagagcttcctgtccgacacccacggacgcggccatctgagcacggcccgcctcgccctcgacgccgagggccgcttcctcggcctgcaggtggagaccgtggcggacctgggagcctatatctccaattacggcgccttcgtccccaccctggcggggaccggcatgctgaccggggtttacgacattcccgccttccatgcccgggtgcgggccatccatactcacaccaccccggtggacgcctatcgcggcgccgggcggcccgaggcggcctattgcatcgagcggctggtggatgcggcggcccacgacaccggcctgtcgccggtggagatccgcaagcgcaatttcattccgcccgacgccttcccctatgccagcgccggacgccacacctatgattccggcgagttcgcccgggtgatggaccgggcgctggaacgttccggctgggcggatttcgcctcccggcaggcggacagcacggcccggggcaggaaacgcggcatcggcctcgcctattacatcgaaatctgcggcggcacctcgggcgaggacgtgaccctgacgctttcgcccgacggcggggccgagatcctggtaggcacccagtccaacggccagggtcacgagaccgcctatgcccagatggtcgccgccgagcttggcctcgcgatcgagcgcgtccgggtgatccagggcgacacgcggcggatcgggacgggcggcggcaccggcgggtcgcgctcgctgtcccagcagggcggcgccatcgcctcggcggtggaatccttcatcgagcacctgcagccccaggccgcccggctgctgcaggccgagcgggcggagttcgacgcgggcttttaccgggcggcgggcggttcggtgtccttcgcccaggtgctggccgaagcggaaacgcccctggcggccagcctgcgcttccgtcccccggccgccacctttcccaatggctgccacgtctgcgaggtggaggtggaccccgagacgggcgagaccgaaatcgtccgctacaccatcgtcgacgacgtgggcaccgtgctcaatcccctgctgttgaagggccagatcgtcggcggcgccgtccagggcatcggccaggccctgctggaacatgcggtcttcgacccggaaagcacccagccgctgacgtccagcctgatcgattacgccgtgccccgcgccgcccacatccccgagatcgacttttccaccgtggaaatcccgtgccgcacccaccccctggggctcaagggcgccggcgaggcgggaaccatcggcgcggcgcccgccgtgatcaatgccctatgcaacgccctggaactccgccatatggacatgccggccacgccgctggcggtgtggaacgccctgaacggaaagctcgaatgaccctgcccgccgatctcgcgcccctgcttcgccccctggaggacctggcccgccgggccggcgcggtggtgatggaggtctacaactccgacttcgccgtgcgcgacaagaccgattcctcgccggtcaccgaggccgacgagcgggccgaggccatcatcctgcccggcctcgccgccctgacccccggcgtgccggtggtggcagaggaatccgtggcggccgggaccatccccgccatcggctccggcccgttctggctggtggacccggtggacggcaccaaggaattcatcaagcgcaacggcgagttcaccgtcaatatcggcctgatccgggacggcgttccggtgctgggcgtggtgctggccccggcacgcggcgagttgtggtcgggcaccggcgccaccgccttcaaggaagatgcgaacggccgccgccccatcgcctgccgcccgctccccgcgtcgggcgccgtgatcatgacgtcgcgctcccaccgcgagcccgagtccctggacaaatggatggcgcagttccccggggccaccctgggcttcgccggctcgtccttgaagttctgcctggtggccgagggcgccgccgacctctatccccgctttggccccaccagcgaatgggacatcgcggcggccagcgccgtgctgatggcggcaggcggcagcgtcaccacctttgacggccttcccatggcctatggcaaaacacccaagttcctcaaccccgacttcattgcccgcggacgagggtaattccctcaaaaagggcggcatcccgcaccaggggcgcaggtaaaactccttgcttttttggcggaattgcgcgactattttcgggtgacgggtttcccgccacccaacagccgccgtaatgcacgtacggtgacttggagacggctcacaacctaaagaggttgtggcggcgcgcgacaccgcccctggggccgtccctgcaagaagcgtcagaaaaggccgccggttcgtccgtcggccttttcgcttttggcgaggcccgacaatccttggcgggcgacagccccgcatgcccccatgcatcccttgacacataagtttatgttgcactgcaacataaactgcctatctcatggtcagaccagttgaaggaggtcggccatgctgatccgcagactttatacccatgaacgcgccgcctatgccgatcacctgaagcggctgtcgcccgatgaccgccgcctgcgctttgcccgctccggcgtggccgatcaggtgatcgacgactatgtcgccgccatcggcatcgacgacctgattctcgccgccttcgccgacgaccagttggtgggcgccgcccatgtggcgctcaacggctcgctggccgaggtgggggtcagcgtcgaccaggaccatcgcaccgacggtatcggctccaagctgctgcgtcaggcggcgtccttcgcccgtaaccgccgggccgagaagctttacaccctgtgcctgtcggataaccgctccatggtggccctggcgcggcgcagcggcatgcaggtccatttcgagggcggcgaggccgaggcgttcctggatctgcccccgcccgatccgctgacggtgaccgaggagatcaacaccggcctgttcgcggtgttccacgactgggccgagatgatggattcctacagcgccatgctggtgggaggctcggcggtggagccgctgctggaagcgacggggctggcgaagaccgcttgacagggaggctccgcccggagcaaattgcgagtaattcgcatttgcatctcaggagccgtctatgtgtgagcaatgccaccccgccttcgccccgcccgccgactctccgcgtcaccgcgcccggctgtgggaaatcgacagccaatggcattgcaccatcatcggcacctgcctcagcctgggtgagctgaagggggccgccactcgcctcaaggtccggatgccgtcggcccggccgcgggcctatgaaatccataccgggatgattcatctggcgtcgcgggagcggctggtgggcaaggccctgaccaagcttctcgaccgcaagcacgccgccgccatcaaccgcgccaagtcgctggtgggcgaggattccctggccgcgtggtgggaggatggcctgacccggggcgaggtggccgccgcctgctgggcggccatgagccatccggatgccacggattcgctccgcaaccgcatcttcggcgatatccacatgctgtcccatcaggtgggggcggcggcgcgggccgatctcaaatccatccaccagctcgaacgcgacaaggccgagttggaggccaaggtggcgcggcagcaggaccgcctgaaggccgagatcggcaagcgcaacgccgagatccgcgaattgcgccaattgctcgaccaggaagccgccgaatcccgccgtctcgcccatgccgcccaatcggccggcgagatggaccggctgcaccataccctgggcgagatgcgtcacctgctggaggtggaaaccgccttccgccaggtggccgaggacgaggcccgccgcctgcaggcccaggcccgcgaccgggatgcggagaccgaccgcctggagcgggagttgcgcgagatgcgcgacgagctggccgcctcggaaagccgcctcgccgccacactgtccccacccaccgacggcgtggccgagtgcggcgaggattgcgcccggctggatctgtgcggccgctgcatcctgttcgtcggcggccgcaaccagcacctaccccatttccgccggctggtggaagaggccggcggcaccttcacccaccacgacggcggcttcgaggaaagcatgggccgcctgcactccctgttcggccgcgccgacgcggtgctgttcccggtggacagcgtcagccacggcgcccatgacgaggtcaagcgcctgtgccgccgttgggaaaagcccttcgtcccggtccgccgctccggcctcggagccttcatccgggcgctgtccacggtggcggggcagtaggtccccccttttccgccggggcgggaatggactatggtccgggcatgagcacgcatgcccccgtttccatcctcgccgccgatccggccgccatcgcgcgggccgggcgggtgctggccgagggcgggctggtggcctttcccaccgagacggtctacgggctgggcggcgacgccacctcggacgcagcggtggccgccatcttcaaggccaagggccgccccagcttcaacccgctgatcgcccatgtcagcagcctggaacaggccgccgccctggtggagcttggcgccgacgcccatctgctggccgagcgcttctggcccggccccctgaccctggtgctgcggcgccgcgccgattcccccgtctcgctgctggcctcggccggtctcgactcggtggcggtgcgcatgcccgaccatccggtggccctggccctgatcaaggccgccggccgccccctggcggccccctcggccaaccgctcgggccgcgtcagcccgaccagagccgagcacgtggcccaatgcctggagggccgcatcgccatggtgctggacggcggcccctgccgggtcggcgtggagtccaccgtgctggacctgtccgaggagccgcccaccctgctgcgtcccggcggcatcaccgccgacgagctggaggccgccctgggccgtcccatccgccgcgccctggagacccccgacgcgccgcgttcgcccggccagttggaaagccattacgcccccgccctgccggtgcgcctgaacgccaccggggccgagccgggcgaagcactgctgggtttcggccccgcccccgattgcgtcctcaacctgtcgcccaagggcgacctgagcgaagccgccgcccatctgttcgccatgctgcgcgccctggaccgccccgattatcggggcatcgccgtcatgcccatccccgggcgagggctgggtctggccatcaacgaccgcctgaagcgcgccgcggcgccaagggacacacagaaatgagcgaggcgaagccgaagcgcggcgccattgaggcgcccggagcgcagcggaggagccaagggcgcgccagcgaccgcccggcacctgagggacaaacttcgagcgaggcgaagccgaagcgcggcgccattgaggcgcccggagcgcagcggaggagccaagggcgcgcaagcgcccgcccggcgtctgagggacaaacagaaatgagcattctccacgccttgagcgccatcgtcggccccggcaacgtcatcaccgaggcttccgacctcgccccctatctggtggaggagcgcggcctgtaccaaggcgccgccttgggcgtcgtccgccccggctccaccgccgaggtggccgaggtggtcaggctttgcgccgccgccggcattcccatggtgccccagggcggcaataccggcctgtgcggcggcggcgtgccgtccgaggacggacagagcgtggtgatctccaccgagcgcctgacccgcatccgcgccgtcgacccggtggacttcaccctgaccgccgaggcgggttgcgtgctggccaatctgcagcaggcggcggaagaggccggctgcctgttcccgctcagcctgggcgccgagggctcgtgccgcatcggcggcaacatctccaccaatgccggcggcaccaatgtgctgcgctatggcaatacccgcgatctggtgctgggcctggaggtggtgctgcccgacgggcgggtgtggaacgggctgaagcggctgcgcaaggacaataccggctatgcgctgcagcacctgttcatcggcgccgagggcaccctgggcatcgtcaccgcctgcgtgctgaagctgttcccccgcccgcgcgagatcgccaccgccttcgtcgccctggccgatctcgaggcggccctgcccctgttctcccgcgcccgcaccgccagcggcgattcggtcaccgcctgcgaactggtgccccgccgggggctggaactgggcatgcgccacgttcccggcgtgcgcgccccctttgccgcgttccatgactggatgctgctgctggaactgtcgtcgtcgcggcccggcggcctgcgcgaggccttggaggagatgctgggccaggccttcgaggacgggctggcggtggatgcggtgatcgccgaaagcgatgcccagcgcgccgacttctggcgcatccgcgaagccattcccgaggcccagaagaaggagggcggctccatcaagcacgacgtggcggtggccacgtcgcgcgtgccagagatgatccgccgctgcacccgcgccgtggaggccgccatgcccggcgtgcgggtggtacccttcggccatctgggcgacggcaacacccatttcaatctcacccagccggaaggggcggacaaggccgccttcctggcccgctgggaggagatgaaccgcatcgtccacgacatcgtggtcgagatggagggctccatctccgccgagcacggcatcggacgcctcaaggtggacgaactggcccactacaagccgggcgtcgacctggatctgatggcgcggatcaagggagcgctggacccgctggggcagatgaatccgggcaagatcctgcgccggccatgaattagcgaaggccctcacctttcgctgttccgccgcaaggcctatgtctataatcccgcgccatgtcggggattacgcgatacatgatgcgccagatgctggtggggatgatcttcgtctccgccgcgctggcctgtgtcctgtggctgacccagtcgttgcgcttcgtcgagatgatcgtcaacaaggggctgtccatcggcgccttcctgaagctgaccatcctgctgatgccgggcttcctggtggtgatcatcccgatttcccttttcgccgtagtgcttttcacctacaaccgcttgattgcggaccgggaactggtggttctgcgcgctgcggggctcagccatctggccctggcgcggccggcggtcattctcggcctggcggtcagtgccgtgggctacatgctcagttgctggatcattccggtcaccgtgcgcagcttccacgagatgcagtggaccatccgcaacgacatcggcaacgtgttgctgcaggaaggcatgttcaacaagttcggcgagggcttgaccatctacgtccgctcgcgcacccccaacggcgaactcaccggcctgctggtccatgacaagcgccatgcccagcgcccggtcaccctgatggccgagcgcggcgccctggtctataccgagcagggtccccgcgtgctgatggtcaacggcaatcgccaggaagtgacccccggcaccggcaagctgtcgctgctgtatttcgacaattacaccgtggacttcaacaccgccaccggcgccaagcacgaccgggtccgtgatgcccgcgaacgctcgacgctggaactgctggccatcgacagcagcatggagaacaagggggagttgcgccggttcaagtccgagctgcattcccgcctgacctcgccgctgtacagcctgggctttcccctgctggccgccgcggtcctgctgacctcgggcttcgaccggcggggccagaccgcccaggtgatcaccgccacggccctgatggtggcggttcaggcgctggcgcttggcgcctccaacctgtcgtcgggcaatctggccttcgtgccgctcatctacatcaatgcagcccttcccatcgccctcggcctctgggtcctggcgcgcccgccgtggccgcgtcgccggaccaatgcggcctccggcacggctacggcgacatagggtgaccaccgtgccatcgtcccgccatctgctcctcatctccctgctgtcggcctcaacggcgctgaccgtccccgtgcgcgccgacgtgatcaccgagcagaaggcctggccggaagcgggaggctggggccaggcctggggcgacgacgacccggccgccgcccgcgcaccggcgcagcaacgcccccgcccggcgcccccccaggccgccccgggatatgtgccgccgcccgccgccgccgcccttcccagccgccccgtcgcacccgtcgcccaggcgccggtgcatgcggctcagcccctgccggtcaccgagatgggcgccgcctatcccgagaccgggtcctggggccaggcctggggcgacgacgagccggcgcccgccccggcgccgcgcagccgcgcccttcccccgactaccatgccccccgagccggtccagcagccgcaacggcggcagcaggccgctccggcgcaggagcagccggccatccgggcggaagtctccccggcggcccaggctcagcgttcaacctcgcgcgccatgcagcgggcctcggtcatcatgcgcggcgaggacgagagcggcgatgcagtcggcctgaagcgcccgccacgggtcattccccgccccctgcgccacctcaagaccaccgaggacggggcggagccggtccatatggtggccgaccaggtgatctatgaccgcgagttcaacgtggtcaccgccaagggccgcgtcgagatgatgcatgacggccgcaccatcaccgccgacaccgtcagctacaacatgaagcaggacgtcatgggggcgtcgggcaacgtggtgctgaccgagccctcgggcgaggtgacccatgccgactacttcgagctgacgggcgacttcaagaacggcgtggcccgcgacatccgcaccatcctggccgataattcccgtctggcggcgcaaagcggccagcgggtgggcggcgaccgcacggatttcgaccgggcggtctacaccgcctgcgagccgtgccgggacgaccccgagcgcacgccgctgtggcaggtcaaggcggtgcgcgtcacccacaatcaggccgaggctcaggtggaataccgcgatgcctggctggaattgaagggcattcctgtcgcctacacgccctacctgtcccatcccgatccgaccatcaagcgccagagcggcctgctggcgccgatcttcggcatgaacagcagccttggcccctcgatcagcaccccgtatttccaggtagtgtcggacaacgaggacttcacgctgacaccccgcttcatgctggaccaggtcagcacctttgataagcccgataaggatgtccccacctcggtcttcaagcggatgcaactggccggacagcatcgctggcgcggggtgcacggcgaagcggtgaccacggccagcatcgcctcggacacgaccaaggaggggattcggggacacatcgaatccaagggcctgatggagctggaccgcacctggcgggcgggctggcagattcagcaccagtcagacctctcctaccgctcgctgtatcgcgttcgcaccgaggaagaccggccctggctgatgaaccgcccctatgtggaagggttcagccggcgcggctatgccatgatggaggccatgtcgttccagggcaaacgggtggtggaggattccagcaagtcgcccgtggttctgccgcacatggtgtacagcaccgtcagctcgccgggctgggcgggtagctattggtcgacggattccgacgtgctggcttacacccgcgacgtgggaacccaggcccagcgcctgtcgaccaaggtggcctggaacctgccgctcatctcgccggatggccaggtcgtcgccttgtccacctcggtacgcggggacgcctacaatgccgaccacctgaccggcacggccaagagctcgggcagcgccgggcgggccatccccgagatcgcccttaactggcgttatccctttacccgtccgggacgcagcatcacccaggtcatcgagccggtggccatggtggcgctcagccccaatgccggaatcgactcgcgcattcccaacgaggattccatcggcttcgaactggacgagaccaacatcatgcgaccgaaccgcctgcctggcctggatcaggtcgagggcggcgccaggggcgcctatggcctgcgctgggcggcctacccctcccgaggcggcgccatcgtcgcccaggcggcccaaggatggcgccaacgcaggacgtcggcgttcggcaccggcagcgggttcaccgacaccctttctgactatgtcggccgcgttgatgtcacgcccatcggcaatctgacgctgcgtgatcgggtccgtctggacaaggatacgctggaagtgcggcgcaacgaggccgggttcggcatcggaccgccccttctggccttttccgccgattacggcatgctgtcgcccagcagcaccaacagcagttcgagcagcaccatttatgccaagcggcaatacgtcaattacggcctcagttcgaccatgtcgcagaattggcggagttcgctctcgctgcagcaggatctggcccagaacggcggcacggtcagttggtccgccaacaccatgtacagcgatgagtgccttgccgtggtgggagcgttcaaccgctatcactccgatatgagcggcctgttgtccggatatcatttgagcctgaccgtggtcttgaagtcgttgggcgaagcgcccgtcagcgtcttctagagggaggaacccaagaatgctggcccgcgccgcaatcgtcctgagcgcactcctcgttgcctgtatccccctccggcccagtgcggcccaggaggtggaccgtatcgccgccgtggtcaacgacgagatcatctcgatccgcgacctggatgcccgcctgaagctggccatcacggtttcgggcctgcccgacaacatcgaaagccgccgccgcgccgttccccaagtgctgcgcaaaatggtcgatgagcgggtgcaggcgcaggaggccgcccgcctgagggtcgctgccggcgccgacgaagtggcgcgcggcgtggccaacgtggaaaaccagaaccgcatgccacccggctcgttgttgccctcgctggccaaagccggcgtcgatcctgatgccgtcaaggatcagatcaaggcggatatcatctgggtcaagctgatcatgcgcacgctccaacccaccattcgggtgggcgaggatgagatcaccgagcggatcgaaaccctgcgccagcaattcggacagccggaattcatgctggccgagatcttcctgccggtggattcaccgcgccaggaagaggagtccaagcgtcttggcgaacgcctgatcgagcagttgcgcgccggcgccccgttccaggccctggcccggcaattctcccaaagcggcaccgccaacaacggcggcgttctcggctggctctccgctgccgctctggaggacgacatccgcgagacggtgtcgcgcctggataagggacaggtcagcggactggtccgtaccggaaccggttacgccatcctggccctgatcgacaagcgggtggcgggcgaaagcaacgtcagcgaccccaagctcaacatttcccaggtgttctttccggtgccgccgggctcccctcccatctcccagttgatggccaaggccgccgagctgacggcgaacgtccgatcctgcgacgagatggatgatctgggacgcaagctcaattcggaacagtccggccgtcgcgatggcgtcaccctttccgttctgccgcagaacatccggtccgtggccagttctctgcccctccacaaggccagcgctcccatcaacatgggcaaggccctgctggtgctgatggtctgctcacgcgacgaaaatgtcagcaagggcggattgccgtcccgtgaggccatgcgccgcaccatcgaggaagagcgcctggagatgctggccaaacgctatctgcgcgatcttcgccgcgccgccttcatcgatttccggctctgatgccgatgcaaggccgaccggcatgaccatcctcgccctgaccatgggcgagcccgccggaatcggaggcgacatcgccctgcgggcctggagtgaacgcggcgtcaatggcgctccgcccttcatgctcatcgacgatgccgggcgcctgcggtccctggccgcccgacttggcctggacgtgccggtggtggaggtctcgtccccgaccgaggcggaggcggccttcgccgttgctcttcccgtcctgcatcagcccctggccgtcagggtcgagccgggccggcccgatcccgccaacgtgcccatggtcacggcggccatcgagcgagccgtggccctggccctggccggcgaggtggcgggtctggtcaccaaccccatccacaagcacgtgatgtaccagggcggcttcgccttccccggccataccgagttcctggccgccctgctgggccgtccggatctgcgcgaagtgatgatgctggcctgccccgaattgcgggtggtgccggtgaccatccatctgggcctgtccgaggccatccgcaccctgacccgggccgacatcgtcgagatcgggcgcatcgtcgctagggcgctggaggtggatttcgccatttcccgcccgcgtctggccgtggccgggctcaacccccatgccggcgaaggcggcgccatggggcgcgaggacgaggacatggtcgcccctgccgtggccgatctgcgggcgctgggcatcgacgccgtcggccccctgccctcggacaccctgttccatgcgcgcgcccgccggggctatgacgccgcgctgtgcatgtatcacgatcaggcgctgatccccatcaagaccatcgacttcgatggcggcgtcaatgtcaccctgggcctgcccatggtccgcacctcgcccgatcacggcaccgccttcgatctggccggcagcggccaggcccggccggacagcctggtggccgccctgaccatggccgccaccatcgccttgaatcgagcccgtcatggctgatctgccgccgctccgggaggtcatcgcccgccacggcctcgacgccaggaagtcgctgggccagcacttcctgttcgacctcaacctgacggggcgcatcgcccgcgccgccggggacctgaccgtcggctcggtgatcgagatcggccccgggccaggcggcctcacccgcgccctgctggatgccggggcgcgccaggtgatcgccatcgagcgcgatgaccgcgccattgccattcagaacgagatcgccgaagcctatcccggccggctggagatcatggccgccgacgccatgaccgtcgacgccgccgaactgggcgaggtcccgcgccgcatcgtcgccaacctgccctacaacatctccacagccttgctgctgggctggctgcggcgcgccgacgccttcgagcgtctggtgctgatgttccagaaggaggtggtggaccgcctggccgcgccgccgcgctcggagcattacggccgcctgtcggtgatcacccaatggcggtgcgaggtgcggccgctgttcaatgtggaccgtcgcgccttcaccccgccgccggccgtgacctccaccgtggtggatttgatcccgcgggccgagcccctggcccccgcccgcttcgagaccctggaacgggtcaccgccgccgccttcggccagcgccgcaagatgctgcgctccagcctgaagtccctcggcggcgccgaggacctgctggagcgcaccggcatcctgccgacggcccgggccgaggaaatcccggtggagggtttttgcgccctggcccgtgcgctggacgcccggactcttgacggacatcagagcgcctgaccggcggcgtgctatactgaccttcaatcgacaggaggcccccatgagcggttggggatgtccgcatcaggaccaggaaaagtgcaaccggctgggcggactgccctgcgaccccggcatgaagggctgcattctggccggacgcttcaggttttccaatccggcaaagaacaggtcggtaaaatcttcggacggaggtggcgcaaccaatgcccccgaagaggaagacgactcatccgttcagtcttagggcgtcataccaaaagccccgacccgcctgaacgcaggcgttgacgcatcccctggcaataggttttagtgagtcccaatatctaaggtacccgatagaggtgccgttgaatgggtgaattgtactctgggagaaagcggaatgacggctgagcgcgttgggaattccccgacggcggagagtgttgattcattcgccaccgaggtcttgaagcagatcgacagtctcagccttgaggtcgccgacatcgccggcaccatggatggcctgacccgtttcgtgaagcatcaggaagaactgttcggccatctcaagatgatcgcccacgccatggccgagaccatcgggctgatcgacaatgccggccgcgagacccgcgacatgacggtccaggccgggcatcaatcctcggaatccctgcgcacggtggaagaggccctgtcgggcgtcaaccagctggtgggcgcggtccagggcatcgaggagcggctcgaaggcctggaaggcgccctgggcgaagtcagcaccatgtcgcgcaacatccagaagatcgcgcgccagaccaacctcctggccttgaacgccaccatcgaggcggcccgggccggcgaggcgggcaagggcttcgccgtggtcgccaccgaggtcaagaccctggcgcgccagaccgccgacgtcaccagcggcatcgacgaaaccgtgcacaagctgtcgggctcggtcaccgacctgatcgagacctccaccgacaccctgaaaatggccgattccgtcggctcgggggtgggcgtcatcaatcaggccgtctcggtgttcggcgacgtcatcgaatcggtggaaagcaaggtgggcgacatctcccaggccgcttccgcctccctgtcccagtgcggcgacgtgatcggcgaaatcgacaagttcttcgaaggcatcgccatgaccagcgaaagcctgcgcaaggccgacgagcgcatcgcctcgttgctgggcaattccgaggaactgatgggctatatcgccgcctcgggcttccgcaccgccgacaccccgttcatcgaggcgatccagtccgccgcccgtcaggtgaccgcggcgttcgaccagggaatcgcctcgggccggatttcagtctccgacctgttcgacgagaactatcagcccatcgccggcaccaatccgcaacagcacaattcgcgctacgccgccttcaccgatctggtgctgcccgatatccaggagccgctgctggccctggacagccgggtggccttctgcgtcaccatcgaccgcaacggctatatcgccacccacaacaagaaggtgtcgaacccccagggcagcgacccggtgtggaacaacgccaattgccgcaaccggcgcatcttcaacgaccgcaccggattgtcggcgggcaggaacaccagacccttcctgctgcagacctatcgccgcgacatgggcggcggccagttcatcatgatgaaggacgtctctgcgcccatcatggtgcagggacgccactggggcggcatccgcctgggctaccggatctgatcaacggcatttttgcgggggccgccttcttcaaccgggggatggcggccccttcttgttgggcgtatcatgggcgataggtaggcattccgcagggaggcttccatgaccaccaatatcctttccgtaatctcggccatggccgaagtggcgacggtacctcgccaaggcgagcatctgcgcccacgtcagccggtcattaccctgtcgcgcgatttcggctcgggcggcgacgtcatcgccacccgggtctgccagcgactgaaactgcccctctacgacgaggaattgctgcgcgaggtggcgggccgcctcaacgacgacccggccatcgtccgcctgatggatgaaggatttggccgggccaaggacatgtggctctaccgcctgttctcgggcaaggacatcagtcccgacgcctatcgcgattccctggtcaaggtggtgatgagcctgggacgcctgggcggcatcatcgtcggacgtggcgcccacatcatcctggcgggtgagtgcgcgttgcgggtgcgggtggccggcagccccgaggtctgtgccaagcgcatggccgaacagggccacggcaacgaggccgatcttctggccaaggcccaggagatcaatcaccggcgcggcaagttcgtgtgggaggcctttcactcgcgcctgtccgacgccagccagttcgacatcaccatcaataccgaccgcatggaggatttcgaggatgtggtcgagaccatcgtcgtcatggccgaggcggtccattccggccgcgtgctgcgtggcgacctgatgcacgcccacgtctgaccccgctcgaccgccgggcgcctgacaccccggcgggccgggccggacccgggaggggagttccccctcctctcccggatgttgggattatttccccggcagcatgcgggccatgacgtcgtcgcgcaagatgaagcggtggcgcagagccgccgccacatgaccgatcaggatggcggccaggacccagcccagcacttcatgcccttccttgaagatggccttgagagcgtcatccttggccaccagggcggggagcaccagcccgaacaccgagacctcgcgcccgccgctctggctcatcaggacgccgtccatcggaatcagcagcatcagaaggtaaagcgccacatgcccggccttggccaggagctgttcaccgggggacatggacgacggcaggggcggctgcggccggatcagccgccaggccagccgggccaccgccatgaccaacatgaccacgccgatggccttgtgcaggccgatcacctcggaccgcaccggccccttgggcagcgcgtcgatcatgtgcccgaccacccacagggccaggatggccgcggccatcacccagtgcagcgtccttgccacggtgtcgtagcgcgccggtacagcagtattcatggcaggtccccaacctttcgagtcggcgagcagcctagcacgataccccggaggttgacattgccgaccgagcgcatacccttcatgaggggtttataccaacctgcgtcgagtgaaactcatcgcgggttggctaggcccaaggggccgcgcgccttgcggcgcgggaggcaagggcgcacagcgcccgcccgccgcatgagggcgctgcggtgatcggtttcgatcgccgcagcttggtattatcggggttgctgccaatggcacgtcgcgcattgcacatagcttccgtcgcggcatgtctcgcgacactgtcgggcatggccggctgcggcggcatcgtcggcgtccctccgcctgcggaatcctggccctcgccacagccggaggtcgtgccggagccggtgcgctaccccgaggtccgcctcaacgtccccacggtcatcgcttcagatcccgaggcccagcgcttcctgctgctgcgccagctggtggaagccgggctggtcacgcccgacgaagcctcgatccgacgcaacgccaatattggcgcgcttctgccctattccgcgccgcccccggcctccgggctgggacggccggtggcgttgcgcgacatcgccgaccgcctgtcccgcctgtcggtccccacggccggtgtaccggcctcggtccggcaggccgagcgcgacttcctgatggacggcctgctgccggccgagcccagcttgcggacaccgccggcacgcaaggacagccccgccctggccacgggccggcggcgagccgaggatatggcccgcctcggcctggtggagcatgacgagtttcagcgggaaatggccgccatcatcgccgccgagcgggacctggccaatgcccccccccctccgccgccgccgcccaagaagaagaggcccgcaccaaagaagaccgtccccgacggcggcgtgcccggcgccacccgcgagggcgacacccccggcggaatcgtgccgttcaatcccaaggcaaccttgggcctccaccttctgtccatggcgtcccccaacatgacggacaaggctgtggacgccctgaagaaggaatatccagaactgtccgccctggagttcaaggcggtcaaaaccgatattcccgacctgggcaccacctatcgcctgatcgccggccccatgtcgggagccgatgccgacaccctgtgccgggcattgcgcggcaagggccagtcgtgcgccatcgcaaacttttaggagcggcaccatgccgacattgccgcaaacggagccccggcatccgtagaaacccttgccctcccccagggagcagcctattctttcgtcaagctatatatggcgtttggcgtgacacatcccccatcgtccccttcctcggccggcccgacaacatccgcgcccaatgcgcaggaccagcgggattctgacgccaggcgctttacccgccgccttgtttccgccgtcctggccctcaatcttttcgtcggcgcgctggtcgccagcgtcctggtcatgagccggtcccagcaccggcatcaggccatggccgtggccgataacctttccaccgtgctgcggaccaatctgcatggcaccatcgccaagatcgacctgaccttgctggcggtcgccgacgagatcgcgcgccaggagagggtcggcggggtcgacgccgcccagatcgaggatctgctgcgacgtcacgacgagcgcctgcccgaggcgctggggttgcgggtggtcgacgcctcgggaatcatccgttacggggtgaccggcatcaaggtcgcccaggccagtatcgccgaccggccgcaattcatcaaaatgcgggacgacccgaaggccggactggtcatctccaagccggttctcggccgcgccgcccagacctggatggtcaccctgagccggcgcctcaacgcgcccgacggctcgttcgcgggcgatgtgcatgtggccctgccgctcgacaaattcacggaaagcttttccgccatcgatgtcggcccccagggttcggtcagcctctgggatgacggcccctccattctggcccgcgcccccgagctggacggccccggcggcgtggtggccaaggcgccgaagccgtcgccgcaattgctgtcgctcattcagtccgggaccggcaaggcggcctatcacgcggattccaatgtggacggcgtcgcgcgcagctatcacctcagccggatcggcagctttcccctctgggtgatcgtcggcctgagcgaggacgactatctcgccgattggcggcgacaggcactgatcatggtggccgtcgccatgggcttctcgctgctcagcgtgaccgtggcgaccctgcttctgcgcagctggcgcaaccgccacgcggcggcccgcgccctggaggccgcccatgtccagaccgaggaggctcgtcaccgcctggagctgatcctggcctcggcgggcgaaggcatttgcggcgtcgatcccgagggccggatcaccttcatcaatccggcggcccggcgcatgctgggctggagcgagaccgagggtgtcggcctcaacctgcacgaggaggtccatcatcaccgggccgatggcagcgaattccccgccgtcgcctgtcccgtgtggcaaaccctgcacgacggcaacattcgccacgtcccccgcgatgtccattggcggcgggacggcacccccgtcacggtggaattcaccaccgcccccatcattcagaacggccgcgtggctggggccgtcaccctgttccgcgacatcgcccggcgcatccgggccgagtccgaagccgcccgcaacctggcggtgaccacggcgctgggcggcatcctgcgccactcgctggaagaccggcgcctgaacgacatcttgcacgattccctggtggaaatcctcagcctaccctggctgaacgtggaggaacggggcgccatcttcctcgcccagcccgacggcaagaccctggcgctggtagccgagcacaatatgtcacaggccatcatccaggcctgcaccgtcatccggatggggaattgcctgtgcggcgccgccgcggaacggcgcgaagcggtgtttgcctcccacgtggacgagcggcaccagacccaggtgcccgacatgcacccccacgggcattactgcatacccatcatgaacggccccgatcttctgggcgtgctcaacacctatatcggccacggccatccatggcagaaggaggaagagcatttcctgaggatggtcgccgacaccctggcgggcatcatccgccgcaagcagatcgaggaaacgctgaggaacagcgaggaactgtccaagaccctgctcaacgccaccatcgacggcgccctgctgatgactcccgaggggcggatcctggccaccaacgaggccctggccgcacgcttcgccacaacccccgcccagatgccaggcacctcgttctttgactggctgccgcagcccctggctgaaaggcgtcgcgaccagttcgcccaggtcctggccgacaggcggcccctgcacagcgtcgacgagcgcggcggcgccatcttcgacaaccgcatctatcccgttcaggatggggacggagagatccggcggatggccgtgttctcccgcgatgtcaccgaacagcgccatgcgcaaaaagccatcgagaaggccttggccgatctggcacgctccaatgccgaactggagcagttcgcctatgtggcctcccatgatctgcgcgagccgctgcgcgccatcaccggccatctgcaactgcttcagcgcctggccaaggacaagctggacgactatgccctcgaatccctgctgttcgccgtcgacggcgcgcgacgcatggatctgctgatccgcgatctgctggactattcgcgcatcggccacgccgaccgcgagatggaagacctggacctgggcgaagtcatcgccgacgccctgtccaacctgtccgccgccatcgccgagggccacgccaccgtgaccaccgccacgggcatgccccacgcccatggcaatcgcatggagctgacccgcctgttccagaacctgatcggcaacgccctgaaatacaggaaccccgagcgccctccagaggtcgagctgcgggcggtgcgggtcggcggcgcctgggacatctccatccgcgacaacggcatcggcatcgagcccgagtatttcaaccgcatcttcatgatcttccagcgcctgcacggacggggccagtacgagggcaccggcatcggactggccgtctgccgcaagatcgtcgaccgccacggcggctccatccgcgtcgaatccgagcccggcaagggcagcaccttcaccgtcactctgccggtgatcggaggatagagtcatcgtgcgaagcccctccgcttgcgcggcagggcgaccgccctgacccgttcggaggcacagcctccgaacctccaggttcttttgatctcaatgaattaataaactgaaaggttcgggaagctgtgcttcccgatcgggggatcgggggcaaacgcccccgaagtggagcttttccgcagcccccagcggtcacccctgtctcaaaaaaaggcggcccccgcaggagccgccttgatcgaccgaccggtcagctatggtgatttacaccgccttgacctggacgtaggagccgggggccgcctcgatggccttcagcttgccgtcgccgggctggcgggcgggaacctgcttgccggcgaacttctcgacccacttctgccaatcggtccaccacgagccctccacctgggtggcaccggccagccagacttcggggttcttgggcttcttggcattggtccagtagcagtacttgttggcggcgggcggattgaccacgccggcgatgtggcccgaggccgacagcacgaacttgatggggccggacacgttctgggtcagggcataagtgctctgccacggcgcgatgtgatcctcgcgcgtcgatagcatgtagagcggggtcttgatgttgccgaggtcgatcttgacgccgttcagctcgatggcgcccggctcgaccagccggttctcctggtacatcttgcgcaggtagaagctgtgcatggccgccggcatgcgggtcgaatccgagttccagtacagcaggtcgaacgggaacgggtccttgcccagcaggtaattattgaccacgaacgaccagatcaggtcgttggcgcgcatcatgttgaaggtggtggccatgtcgcggccgtccaggaagcccgcctggttcatgcgggtttccagggccgagagctgctcctcgtcgatgaagacgcccagttcgccggggtccttgaagtcggtcatggtggtgaagaaggtggccgaggcgatgcggtcctcgcccttggcggccagataggccagggtgcaggccaacagcgtgccgcccaggcaatagccggccgcattgacctgacgcgagccggtcgccttctcgatggcgtcgatggcggccagcgggccttccagcatgtagtcgccgaagcccttgtgggccagcttctcgtccggattgacccaggaaatgacgaacaccgtgtggccctggtccaccgcccacttgatcagcgagttcttggggcgcaggtccaggatgtagaacttgttgatccacggcggcaggatcagcaagggcttctcgaacgcctgtggcgtggtcggatcgtactggatcagctgcatcaaatcggtctggaagaccaccttgcccggggtgacggcgatgttctcgcccaccttgaaggcgtcgtaatcggtcatcttgatggccaggttgcccttgccgcgctccaggtcatccagcaggttattcaggcccttcagcaggttttcgccccgggtctccaccgtggcgcgcagcacctcggggttggtcaggacgaaattgctgggcgccatggcgtccacgaactggcgggtatagaagtcgaccttcttggcggtgtggtcgtccagaccctcgacattcttcaccacgccctgcatccagcgggcggacagcagataggactgcttgatgaagtcgaagatttcattctcctgccacatctcgtccttgaagcggcgatcaccggaatcgggggcgaccaccggctgggtctcctcccccagcatgcgccgggcggtgttctgccacagcgacatgtaatcctgccacaggttgagattggcctcgaccagcttggccgggtcgctcatcagcttggccgtcatttccatgaaggcgttgccgatattcaaggggtcggccgccgccgcggtggggtccgccgcctggcgggtcagaaaatcagcgacgatgcgctgagagcgttccgcaatgctggtcatcgccttggaaagttccgtcgcgtcgatcatcttggactcggtgcccgtctgctcggccatcagctaccccttacattttacggtgcatccagagtgcaaccatacacggcgattgactgtgtgtcgcgtcgcccgacgttccggtgggtgcaccgcccatcctttccgcccgctccatagacctatatactttcgaaccatggcctgataaacgtgaacttgccgtaaaattcggtccaaacaaaatagtttctcgataccgggggcagcagttcgtccatgttcgattgcatcgaggcttggcgccgtcgttacgagcgccgcaccctggccgtcagccggagcgtcgccatcgccgctctgatcgccggctgctcctatgttcctgacgccatcaatcccgtcgagtggtacaagggcgtcacgggcatgttcgacggtgacgacgcccccgtggtggccgcgccgcgccgtcccgacggctcgttccccaacgtgaacgaggccaagtcctcgacctcgggcaagggactggccggcgacaagagcaacgcccagtacgccccgtcggccaagcgcgagcccgcgcccaccaaggccctggccaagaagggggcgcccgcccagacccaggtggccgaggcgcccgccgccgctccgccgcaggtcgccgcgcaggcccccgccgcccaggcacaggacgcatccggccgcggctcctaccagccgtccctggaccgccgcatgcaggccgcccgcgacgagggccccaacgccccgccccgcaccgcccccggcggcccgccggcccgggccgaggtgccagacaccgttcccacccgccgcggcctgctggccgagcacttccagaaacgcctgaccgaatccgccgtagccaccaataagggcgaccccttctcgggcattcccgccgcccgcacccaggcgtcctacaatcagccggtcaacacctatgccgtgcccgcccagccgccgttgggcatgagccgctcgccggccttcgccgccgataccggcgagcgcgcgccgcaactggtcccccccaagggcatgcggggcgccaagggcatggtggcgccgcgaggccccgccgcccagttcgacgtggcgtcgctgcagttcggccccaacggcagcctgaccgccgccgacggcgcccagctgcgcgaagtggcgtcgctgcagcgccagaccggcggcgtggtccgcgtcgtgggctatccctcgccgggcgccgtctccttcgccggccaggacgatgcctcggtcgccctgggccgcgccaaggccgtggccaagtcgctgaccgcgctcggcgtgcccgccaagaagatcatggtggccgccgacccgaccgctccctcggcctatgacgacagcggcgccaaggtttccatcgagtattgatggttcggctggtttgaacggacgtcaggactgcatgcctgggtccgttcaaacagccatcgattcttaaccgctgcggcgttagggtccctgtcccaggggggccctcgcagcagattaggttcggcccatgagcagccagcacgactttcaccgcatcaagcgtcttccgccttatgtcttcgccgaagtgaacgccatgaaggcgcgcgcccgcgccgccggcgaggacatcatcgatttcggcatgggcaacccggatcagccgacgcccgcccatatcgtcgacaagttggtggaagccgcccgcaacccccgggcccaccgctattccatgagccgcggcattcccggcctcaggaaggccctgtcgggctattaccagcgccgcttcgccgtcgacatcgaccccgagaccgagtgcatcgtcaccctgggctcgaaggaaggcctggccaatctggccaacgccatcaccagccccggcgacatcgtgctggtacccaatcccagctatcccatccatccctatggcttcatcatcgccggcggttcgtgccgcttcgtgccggtgaccccggatgccgagttcctcaaggcgctggaccgcgccgtgcgccattcggtgcccaagcccatcgccctggtgctgaactatcccagcaatcccaccgccctgctggccgacctggacttctacggccaggtggtggagttctgccgccatcacggtatctggatcctgtcggacctggcctattcggaaatctatttcgacgtggccccgccgccctcgatcctgcagattccgggggccaaggagatcgcggtcgagttcacctccatgagcaagacctacaacatgccgggctggcgcatcggcttcgccgccggcaacaagacgctgatcgccgccctgggccgcatcaagagctatctcgactacggcgccttcacccccatccaggtggcagccaccgccgccctgaacggcccgcaggattgcgtcgacgacatccgcgccctctacaagggccgccgcgacgccctgatcgaaggcctgtccgccgccggctgggagatccccagcccgcccgccaccatgttcgcctgggcgcccatccccaaggccttcgcccatctcggctcgctggaattttccaagctgctgatgcgcgaggcccaggtggcggtggcgcccggcatcggcttcggtgaatacggcgattcccatgtccgcatcggactggtggaaaacgtccagcgcacccgccaggcggtgcgcaacatcaagaccttcctcggcagcaccgggcaggtgctcgaggcctcggaaaaacagcgtgcaggaacggaaaaatgagcaaggcgccccttaaaatcgccatcgccggattgggtaccgtcggcggcggcaccgtgcagttgctgcacgatcacgccccattgctggccgcccgcgccgggcgcccgctggccctggtgggcgccgccgccctggccaagcccgccgacctgccgctggacggcgtgccgttcttcaccgatgcccgcgacatggccaagacctgcgattacgacgtgctggtggaactgatcggcggcgccaagggcatcgccctcgacgtggtccggacggcactggagcgcggcaagtcggtggtcaccgccaacaaggcgatgatcgcccaccacggcatcgaactggcccgaatcgccgaggccaagggcggcaatatcggcttcgaggccagcgtcggcggcggcatcccggtgatcaaatccctgcgcgaggggctggccggcaaccgcgtcaccaaggtgatgggcatcctcaacggcacctgcaactacatcctcaccaccatgcgcgattcgggccgcgacttttctgacgtgctggccgaggcccaggccctgggctatgccgaggccgatcccagcttcgacatcgacggcaccgacaccgcccacaagctggccatcctggcctcgctggccttcgccatgccgctcgacatcgacgcagtgtcgtgcgagggcatccgcaatgtcagcgcgctggacatccgctatgccgacgagctgggctatcgcatcaagctgctgggcgtggcgtcgctctccgaccagggcgtcgagacccgcgtctatcccgccatggtgccgctgtccttcccgctggcccatgtgagcgggccgttcaacgccatcgtcaccgagggtgatttcgtcggccgcaccgtgctggaaggccggggcgccggggcgcgtcccaccgcctcggccgtggtcgccgacctgatggatctggccaccggccgggtgggccccaccttcggcatcgcggtcgacgccctgaaggccctgcccgccgcgccgtccggtacccatcgcagcgcctattacatccgcctgatggtccgcgacgagcccggcgtcttcgccgacgtggccggaatcctcaaggcgcacaaggtctccatggagcagatcatccagcgcggccgctcgccgtccgaggtggtgccggtggtgatgaccgtgcacgagaccgacgaggcctccatgctgggcgccgtgaaggccatccgggcgctgggctcggtcaccgacctgcagctcatccgcatcgagtcactttaggcgacggcccatgtccatccacaccaccaccttgcccgtcctcgaccgcaaccttgcgctggaggtggtgcgcgtcaccgaagccagcgccctggccgccgcccgccagaccgggcgcggcgacgagcgggccgccgacgaggccgcctgctcggccatgcgccacgccctcaacgggttgtccatggacggcgtcatcgtcaacggcgagggtgatgattccacccagccgctgcacaccggcgaaaaggtcggcaacggcaagggacccaaggtggacatcgtcctgaccgccctggagggccgctccatctgcgcgcgcggcgcccataacgccctgtcggtggtggccatgaccgaggagggctcgttcctcaaggtgccgcagcactcctacatggaaaagatcgtggtgggcgccggcatgccggccggcatcatcgacctggattccacgccggaggagaacctgtcgcggatcgccgaggccaagggccagaccctgtcggaactgacggtcagcgtgctcgaccgcccccgccatggcgagctgatcgagcgactgtatgccgccggggtgcgggtcatgctgttcgacgacggcgacgtgtcgggcgccctggccgccggcctgcccgattccggcatcgacgtctacatgggctcgggcggcgccgcccagggcgtgctggccgccgccgggctgaaatgcctgggagcccagatgcaatgccgcctgctctgccgctcggagcaggaccacgcggcggcgcgccgggtgggcatcgccgacacaaggcgcaagtggaacatcgaggacatggtgcgcggcgaggtgatgttcgccgccaccggcatcaccgacggccatgtgctgaagggcgcccgcctgatgtcgggcaaccgggcggaaagctactccctggtcatgcgctcggccaccggcaccatccgttacctgagcgtccagcacgacctcagccggagccatctgcccgcatgagccacggaccgtcagtcatccaccaggggcccgccttcctgggggtcgagcgttcgctgtccgggcggcgctggctggcgcggccgggcgacgagcggctggcccaggccctggcccagcgcctcgccctgcccgaactggtgggccgcgtactggcgtcccgcggcatcggcctggacgaggcggaaagcttcctcaacccgacgctgcgcgacctgctgcccgatcccggccatctaaagggcatggacaaggcggtggagcggctggtcgcggcggtgacccggggcgagaccatcggcatcttcggcgattacgacgtggacggcgccacctcctcggcgctgctccgaaacgccctggccgacatgggggccaaggcccgcgtctatattcccgaccgtatcaaggagggctacggccccaacgcccccgctttgctgcggctcagggacgagggcgtcgccgtggtggtcaccgtcgattgcggcaccaccgccttcgacgccctggagaccgccacccgggcgggcctcgacatgatcgtggtcgaccaccatgtgggcgaggccgccctgcccgccgccctggcggtgatcaatcccaaccgcctggacgagaccagtccccacggccatctggccgcggtgggggtggccttcctgctggccgtagggctcaatcgcgggctgaaggccgccggctggtaccagtcgcgccccgcccccgatctgatgcgctggctcgatctggtggccctgggcaccgtctgcgacgtggtgccgctggtgggcgtcaaccgcgccctggtggtccagggcctgaaggtcatggccaagcgcgccaatgtgggcttggccgccctggccgatgtggccggcgtcaaggaacgcccggattcctacaccctgggctatgtgctggggccacgcgtcaatgccggcggccgggtgggcgaggccgagctgggcacccgcctgatgtccaccgacaacccggccgaagccgccgagatcgcccgccagctggacggctacaacaaggaccgccaggagatcgaggcggtggtgctgctcgacgccatcgagcaggtggaaacccgccccgatgacggccgccccctgctggtggcggcgggcgagaactggcaccccggcgtcatcggcatcgtcgccggacgcctgaaggaacgctatggccgcgtcgcctgcgtggtggccctggaaggcgaccagggcaagggctcgggccgctcggtgcccggcctggacctgggctcggccatcatcgccgcccgtcaggcgggcctgctgcgggccggcggcggccatgccatggcggcgggcttcaccgtggcccgcgacaagctgaccgccctctccgacttcctggccgaacgcctgcaggcccagttggagggggacctggtgcccctgctggaactggacggcgccctggacgccggcgcggcgggcatcgaactggtggagaccctcgcaggggttggtcccttcggctcgggcaatccagaaccccgcttcgccatctccggcgcccgcatcgccaaggccgacgtggtgggctccggccatgtgcgcctgatcctgacgggagccggcggcaagcgcctgaaagccatcgccttccgcgccgccgacagcgagatgggccacgccctgctgtcctcggccggcgccagcttccatctggccggcacgctccgcgtcgacacctggcaaggcaattccagcgtccagctgatcgtcgacgacgccgcttttgcccgctgatacgattttgcagctttatgccttgatttcccccccaagggcggctatcaagtcgccctcgcgcctcgacgtccccttcgtctagaggcctaggacaccgccctttcacggcggcgacacgggttcgaatcccgtaggggacgccactatcaaaaaatcagggaatttaatgcgttagctcaaattgcgagcagcgttgtgagcgcatttgtgatgcgccgctgaaaatgcccggcggccaaatacgaaagatgccatagctattggctacttggtctttcgagccttgggctgttcagaggcggggctggcttttgccacatctacttcgacgggcgagatctgtggcttttccgtttggtcagcaacaaataggctgaccaaacggaggccacaatgaatgagacccgcgaatagcccctagcttcgcagacgccttcgtccctaaaaatgaggcacggaggatttgatgacgaagacgcattgcaccttaggctttcttcacgaattctgactttaagttcatagcgccgatcccgtcgatcttgcaggcgatgtcatgaccatcgactgcatcggtcactaggcggatgttcttcaccttggtgccgcccttgaccaccagggacgaacccttgacctttagatccttaatcacggtgaccgaatcgccattggccaacacattgccgttggcatccttgaccacgcttccgtcagtggcctccgcagcggtgtcggggttccattcatgggcgcattccgggcaaatcatcagactgccatccgaatagacatgttcagacgaacatttggggcacttcaactcatcgcccatttatcgacctcgtattcacgacaaactcaaaggctagcataccttgttgccatggcggcacaaggatcgcgcgcctatcttggagaatgccggggtcaccctgctttgagctactccccgttggtcggacagatttgggggacgtttcagctactctccgggtccgcggatccgtttggttgaaggtgttccagtagaccagggaggagccttccgttatgggctgcaagtggctggtcgtggttgtagaaggtcatccagcgtccgatctccgcccttgcctgcaatccggtttcccaggcatgccgggaccgcaccgagtcctcgttgaccgcagccttcttcttggccccgcgttcgaagatatcggctgccccgtccaacggggccttcttccattgaaggatcatggtcggatggacgccataggccgacgcaagttccaacaccgttcgctcgccctacagcgcctcaagggcgacacgcgccttaaacgccgcgtcatggttcctgcgcttcgacatctctgatctcctcgtcgctggggatctgcgaccatcagatcgtagcttccgccagtgtccgatttccggggagcagctcaatttagtcgggacaaacccacagattcgcggcgagacaaacgtgctcgcggctgcattcggggcacttcattccgctggtcatcatccacctcgtcgatttcggggggcaggacggccactaacccgcagaattgtgtggcaattcgggaggaaccggaaaatcgagggcgcggttcgccggaagtgttgcaacttgtcgcgtgatccggccagacttgccctcggggctacaggcggggacttgatgaagagctggctgatattcgtgatggcatggttcgcctggggcgtgctgccggccggtgccgcccccctggaccagaccctggcgcaggtgatggagcgttttcacttccccggcgcggtcctgctggtttccgggccgcagggaacggagatcgccaccgccggcaccgccaatctggcggcgccgcgcccggtgaccgaggccacccgcttccacatcgcctcggtcggcaagatcctgacggcaatcgccaccctgcaattggtggaggaagggcggctgtccctcgacgctccggttcgccccttcctcgacccgccggaggcgacgcgcctgacccacatcgactccgccgatgtcgccggcctgctgtcgcacacctcagggcttcccgactgcctgcgcaacggcccgttctcgctgcccgagcacccctcgctgacctggaccgcatccgaggccctgcggctgggccgatgccgcgccgccaccgaaccgggacggttcgcctattccaattccaactacatcctgctgggacacatcctggaaaagctggacggaggcgatctggccgagattctgggccggcggatcctcgccccgctgggcatgggcgacagcgccgtgcgggtcgccacctccgatccgctgctcgcccacggccatcgccgcaatccggatcagccaggccaccgcccagccgggccggtggcctggtcgtcacggctgggcgacgccccgctgaccaccacggcccgcgatctcgagcgcctgatggtcagcctgttccgcccgggcaagacgcgggtgctgcccacccggatggtggccgccatggccatcgaacgcggacgcgccgacggcgaaggctatggcctgggcctgcaggtgaccgagacggacctgggctttcgctatggccatagcggccgcttcggcggtttcgccgccgaggcctggtactatcccgaccgggaccgcatcgtcatcctgctggccaatggtgacgagttctcggagaccgaccccatggacctgatcgaggaacagctgttcccgcccgccgatctggtgcaggcggccgagatcggctcaccctgaagacggaacctgaccgcccctacagaaaggtcgcgcctatgcatcggttgttcagcatcctgttcctcttcctcgttcttgccgctcccgcccgggcggcgggactgatcgaggaggacaccaccatcgaggccaggttcagggacgggaccgtggcgctcgaggccctggtggtccgccccgacgacggacgcaagcacccgctggtggtgctcagccacggggcgccgcgcaaggccgacgaccgcgaaggcatgcgggcccgcaaccagatcgccaatgcccgcgaattcgcccgccggggctgggtcgtggtggcggtgatgcgccggggttatggcgaatcccagggtgaatacgtggaaagctcggggcgctgcgacgatcccgactacgtcaagtccggccggatcgcggccgacgacattcgccagaccatcgcccgcatggcggaaaagccctatgtggatgcctccaaggtggtggcggtgggccagtcggccggcggcttcgccacggtggccctgaccgccgatcccccccccggcctggtggccgccatcagcttcgccggcgggcggggctccaccaagcccgacaccgtctgcaccgaatcccgtctggtcgacgccttccgcaccttcgggcgcacgtcgcgcgttcccatgatgtgggtctacacccagaacgaccatttcttcggccccgctttggccgggcgcttccacaaggccttcaccgaagcgggcggccgggcgcaattcgtcgcggcccccgaattcggcaccgacggtcattacctgttctccaccaagggcgccccccagtggacgggctacgtggaacggttcctggcctcccaggggctgacccagttcgagcgccccctgccgccccgcgatgcctcggccatccactaccccaagggcctgacggagaatgggcgcaccgccttcgccaaatatctggacggcgccacccacaaggccttcgtgatgtcgtcgaccggagccttcggctggcggaccgggcgcaagagcgccgagcaggccgtcgaggaagccacggaattctgcgccgcccacacttcgaaaaagtgctatgcggtgatgatcgacgacgacatggtccagtgatcgggccgggtcttcccggcccctttgcccttaaatccattaacattgggccggaaatcggtttataggacgctgctatatctttcgaccccgacccaatgggatagtcgatagatccaagatgagtctcgccgataccaccaatgccagaacgggacgcaacgcggcgctcgccgtggcgaggcccggccgtcttgtcctggtcgtcgggggggtgttcatcgccttgctgctggccgtgacggcggtcaccgtctatgtccagcggcaacaaagcatcggcgagtggcgcagcaacctgtccaatctctcgcgcctgctggccgagcatgcgcgccagaccatcaacgccgctgatctggtgcagaaatccatcggcgaccgggtggtcgaactgggcatcgagaccgaggacgacctgcgccggatgctgggcagccgcgccaccttcgaagcgctgcgcgacaaggtcagcggcgtcccccagatcgacgtggccaccgtggtggcgaccaatggcgacgtggtgaacttcacccgttcctacccgccgccgcccatcaatctggccgaccgcgactatttcaaggcgcacttcgccgatccggacctcaagttcttcctcagcctgccggccaagaaccgcggtaccggacggtggaccttctacctgacccgcaagatcaggaacagccatggcgccaccatcggcctggtgctgaccggcatcgagagcgccttcctcagcgagtattacaaggccgtcaatttcagcgagttcagcgccatctcgctctatcgcgacgatggcggcctgctggcccgcatgcccgagcgcgatgattccatgggcaaggtcctgccccagcccggcattcaggccctgagggacggagtcgagaccttcatcaccagcgaaccccgcctggtcgaccaaagcgacaggcgctttcgcatcgtcgcgccgcgggcggtggccggctatcccctggcggtgatcgtcgccgccaccgaggagctggtcctggccgactggcggcgaaaggcgctgatgctcggcgccggttcgggggggctgtccctgctgctgctggggctgatggtgtggatcgcccggctgctggacaaccgcgagacggccatggccaccgcccggcaggcgcagcaggtggccgagcgggccaatcaggccaaagccgcctttctcgccaccatgagtcacgaaatccgcacccccatgaacggggtgatcggcatgaccggcctgctgctggacacccaactggacccggaacagcgccacttcgccaccaccatccgcgattccgccgaatccctgctgaccgtcatcaacgacatcctcgacttctccaagctggaggcgggaaagctcgacctggaaagcaccgatttcgagctggtcggtctggtggaaagcatcgtcgacattctggcgccccgcgcccatgccaagggaatcgagatcgccagcatggtcgatcccgacctgcccgcctgggtgcgcggcgatcccgggcggctgcgccagatcctgatgaacctggcgggcaacgccatcaaattcacctcccatggcggcatctccatcgaggtcagggacgagacgtcgccggacggagcgggacgcctgcgcttcgatgtcagggataccggcatcggcattccccaagacgccatcggccgactgttctccatgttcatgcaggtggatgcctccaccgcccggcgctacggcggcaccggcctggggctggccatcagcaagcggctgaccgagatgatgggcggcaccatcggcgtggaaagcacacccggcgccggaagcctcttctggttctccctgccgttccaaatggtggaaacggccccgccccagcggccagacctggcgggacgccgcatcctggtggtggacgacagccccatcaaccgcgacgtcctggagcggcaattgcggggcttcggcgttatcgtggcgtcctgcgccgacgcggaatcggccctggcggagcttggccgcgcggcggcaaccggcaccccctgggaggccgccatcatcgatgcccggatgcccggcgtgacggggtcggatctgatcggccgcatccgggccgagccggtcctggcccccatgggcctgatcatcgcctcgtcccagggactgagccccgaggacggctcccccaaggccgacgccttcatccacaagccgctgcgccgccagaccatcctcgccgtcctggcccgggttctcggcctgcctcacgaccccggcctgcaggatagccccgaatcggaaccggaggccatcccgcgccccgcacgccgcttgcgaatcttggtggccgaggataatccggtcaaccagcaggtggccgtgggcctgctgcgcaagctgggccattcggtggacgtggccgccgatggcgccgaggcggtggaggcggtgcgctcgcgcccctatgatctggtgctgatggacgtgcagatgcccgagatggacgggctgcaggccaccgccgccatccgcgccctgaccggcggcgccgagcgggttcccatcgtcgccatgaccgccaacgccatgcgcggcgatgaccggatgtgcctggatgcgggcatggaccgctacatcagcaagcccatcgatcggcggaagctgatggaggtcctggcccaatacgccgccgaaccgcccgccgccaaaccgcctcaggcggagaatccggctccctcggcggtcgagatcgacgtgctcgatctcttgtgcgaggacctgggcgtcgagaccgtggtggaaattctggccaagttcttcgaggacgccacctcgcgagaggcggagtgcgccgccgccctggcccgcgaggatcacgagcgcgtccggcgcgaggcccacgccatcaagggagccgccgccagcctggggctgaccgatatccgccggaccgccgaggcgatggaggcggccgtccgctccggcgcccccattgccgcccccctggccgcgctgtcggacgccatcgtcaggcttcccgccgtcctggccggctcggcctacgccctgccgcgggattaacccgggctggggccaaggccgtattgaaaagcggccggtcccggccgatactcgtcacggggacgggtgttgctgacgggttcggacatgatggacgtgatcgacggcggcttggcccgcgtatccctgttttcccacatggaccaggcggcgctcggcgatatcgaggcgcgctgcaattgggcgcgggtgccgtcgggcagccagatcttcgacaaggatagcgatacgctggaggtctatttcgtggtcgagggcgcggtgcgcatcctgaccaccggcgccgacgagcgcgaggtggccctggccgacgtcatcgccggcaattacttcggcgaactggccgccatcgacggcatgaagcgctcggcccgggtggtcgccaccaaggataccgtgctggcctcgctggagggcggcgccttcctcgacctgatgcgccagtatccccccatcgccatcaaggtggtggagcgcctgacccgcatcgtgcgcagcctggacacccgggtcgcccagctttccagccagaacgagagccagcgggtctggggggaaatccttcgcctcgcccagcccgatccggcccagcccgaatcctggcagatcgccgatctgcccaatcacaaggaaatcgccgcctgggccggcacgtcgcgtgaaaaggtggcccaggccatcggcgagttggcccgcgaaggcgtggtgcgccgccgctccatggggctgctcatctgcgatctcgcccgcctgcaactgatggcggcctcgcgcggggcggcctgacggccagtaccgctaaaacgtgaactgatcatcggaaataaaacttatgtctctgtgtgagtcttcacagacggcattggtatggtatggcatattttgtctcacgagatagagggcgggaaacaagacatagtctggacccataactctcgaacggaagcgatggtgaaagtcagagtttccggaacacaattcaaggagatagaaaatgttcacttccatccgcactctgatgaccaagctttcccgtgacgagcagggcgccaccgccatcgaatacggtctgatcgccgccctgatttccatcatcgccatccccggcatgctgatggtcggcccgcgcatcctggcagccttcaccaatatcgccggcagcatgtagtcggaaccggcgccgcttcggcggcgccctccggacgtgagttggcggtccaagaaaaagaggcgcttctccccgtgagaggcgcctctttttcttggaagcgtccacagcgttttcataaaatttgaaggaactcgtgcaaataaaatttagttctatgtgcatactttcacagaaacaaaggtcatagcgtggcacattaggcctcaagagatacggggcgggaatgtagagaacaacttacaccttcatatctcatagacaaaaacgacggcaggccaagccggccacgatgaaaccaaggagacagaaaatgttcacttccatccgcactctgattatcaagctttcccgtgacgagcagggcgcaaccgccatcgaatacggcctgatcgccgccctgatttccatcatcgccatccccggcatgctgatggtcggccctcgcatcctggcggccttcaccaatatcgccggcagcatgtaatcggagctggcgccgcacaagcggcgccgcctgattgaagtcaccaccaaaataattgaggcgcctttccaccggatggcgcctcaattatttatacgcattgcgtcggcaagcgattgacaaaaggtaaaactttagtctctgtggacagactcacagtcggcataatggctaaagcagtagggtcttttccaggatgcgggcgggcatggaccatggcactttccggggaaggtggcccgggtccgggaggcgggaatgggcgacatcatcttgatcctatcggcggcggttttcgtcgtggctctgctcgacgccgcctggggcgatctgcgggctctgcgcatccgcaaccgggttcccctggcccttctggcggccttcgtgccggcggccctggccgggggcctgagcggcgaggactggctgctgcatctgggcaccggcatggcctgcttcgtggtggcggcgatcctgttcagcctgggggtctggggcggcggcgacgccaagctggttccggccgtcaccctgtggctcggcccggccgctctgccgcgtttcctgctggtcatggcggtggtcggcggcctggtggccctggccgccctggtgcggcgccgcgccgaggcgggaagcctgcgtccggccctgcgcacccacgtcccctacggcatcgccatcgccgccggcggcctggactgggcggcactcagcctgctgccccgactgaccggctgagcgggcaagaggtgcatcatgcgacccatcgtcatcatcgtcgtcgtggcggccctggcagcgggaggcaccgccatgctggccaaatcctggctggaccggcaggaagcccgccgcgccaaggcggccgacgagcccgccacggtcgagatcctgatcatcaatcgcgacgtcccctcgggcgcggccctggcgggtgacgacctgcgctatgagagctggcccaaggccgccgtttcgccccgtctggtgacgcgcaagccgggcgaggattccaaggcggccttcgtcggcatgatcgcccggcggcccctggccgagggcgagccggtctcggccgccaccaccttccgccccgaagcctcgggcgtcatggcgggattgctggcgccgggcatgcgcgccatctccatcgccatcaccaatcccacggcggtgtcgggcttcgtcacccccggcgaccgggtggacgtggtgctggcctccgacatcaagaaatccgaggaaggcatcaatgccgaggcggggagcggcctgctgctgcgctatggcgccgagacggtgctggccgacctccgggtgctggccatcgaccagcagatcacccggggccgcgacggcgcccccatccagggcaagaccgccacgctggaagtgacgcccaagcaggcggaaattctcaccgtggccggcatgatgggcacgctgcaactgtcgctacggccccagcggggcgaggacggcgccgccaagccggcaatgggcgaggtgctggactttaccgccgacctggaagcgggcaaggtgctccaggcggtggtcggcttcaagccgaaggccgagcggagcgcggcccccgcccccacgggcgtgcgggtcaaccgggccggccagatcagttctgaggggatgggacgatgacggggcgtctgcttgttgcggcggtgttggcggttttcctggcggccccggcctgggcccgggacgaggaaccgccgccgcccctgcccgcgccccgcgccaaggtggtcactctgggctcgccgtccgaggccgcccccagcccgaggcccggcacgccgcaatccctgcgcggcctgtcctccgccgcggcggaatccatgcaggtaccggtgggcaagagcatcgacctgcccctgcccggcgccgtcaaggaggtggtgatcggcaattccgacatcgccgacgtgatcgtgcgcaccccccacatggtgcacatcaccggccgggcggtgggccagaccaacgtcttcctgatggatcgctcgggccgggtcatgcgccgcatcgacctggcggttgccatcgattcccaggcggtcaaggacgcgctgcgcgccgtgctgcccgaggagcgggccatcaccgtggaagcggtggccgacagcctgtatctctcgggctcggtgaagaacgacggtgccgcccgcgacgccaagatggtggcgcgacgcttcgtggccgacgacggcaagctggtcaacatgatccgggtggtcaacgagcagcaggtgctgctccacgtcaaggtggccgagatccagcgcacggtgctcaaggagctgggcttcgggctgaccgccaacaagtccatttccctgccgggcactgccagcctgagttccttcaccaccagttccaccgtgggcctgatcgattcgtcgagcaccgccatcttcggcaccgccaccgtgaccggcctcggcgccctggccgccaatttcaacatcctggagaaccagggcctgatccgcaccctggtggagcccaacctgacggcggtgtcgggcgagaccgccaccatgctggccggtggcgagctgcccattcccgtctccaccaccaacggctccatcagcgtcgagttcaagccctatggcgtgttgctgtccttcaccccggtggtgctcgatcccggccgcctcagcctcaagatgagcaccgaggtcagcgccatcgataccgccaacaagaccgccatcaccaccaccatctcggtgccggccttcaaggtgcggcgggcgggatcgacggtggagctgccgtcgggcggctcgatcatgatcgccgggctgctgcagaacgacatcaccgccaacatcgccggactgccggggctgatggacctgccggtgctgggggcgctgttccgctccaacgcctttcagcgcaacgagaccgaactggtggtgatcctgtcggcctatgtgatccgcccggtggatcagcccaatctctccacccccaatgacggcttcgcgcccagttcggacctcaagcgcttcctgctgggccggctgcaggacacctataccacccggggcaagggcgagcccgccgctccgcccgccctgcaggggccctacggccacatcgtccagtgaggaggatcatcatgaccccgctccgcgccctcctgcccctcctgctgctggccgcctgcgaccccgccgacctgaccgagcacgattaccgcctgtcccatcccatcgtcgtggaggagaaagcggcggtggccctgttcgcccgcccggccgagggcgcggcgctgtccgacgccgaccgcgaccgcctgggccgcctggccgaggaatccgcccggcgcggcgccggccccatccagatcagcgtcggagccttgccgggcgaggaggcgggcgccctggccttcgcccagaccctggccgacaccctgcgggcctggggcgtggggccggtctcggtttccgtggccggcggcgccgacgcggtgccgcagccgggaatcgctcaggtccgcgtgccggtctgggaggccaaggccccggaatgcggcaatttcgagcgcggcctcaaccccaattacagcaatgcgccccacagcaactggggctgctcgatccagcgcaacaaggcgctgatggtgcaaaaccccgccgatctggtccgtgcccgcgaaacctcgggccgcgacggagcccgcgccaccaccgtgctggagaaatacggcaagggcgaagccaccggcgccgccaaggaaggcatcgccgcaggctccacctcggacgtaggctcgtcgtcgggcgccaagtcctccggcgggtccaagtaggagattgccatggtcctccgcctgaccatcgaggcgttctgcaccagccaagagacggcccaggccctgcgcgccgccggggccgagcggcaactggccaagtcgcgcctcgccctgctggacggcgggctggcggcggccatcggccattacgccgacctgcccacgccccaggtgctggtggtggaggagagcgaccccgccctgctgcgttcgcgcctcgaccagctggccgaggtctgcgtcgccggcaccaaggtggtggtgatcggcccggtcaacgacatccggctgtaccgcgaactgatggccaagggcgtcgccgactacctgcccgccccggtcgtcccccgccaactggccgacagcctgaccggcctgttcgccgacccggcctcggcgccccgggcccgggtggtggcctgctggggggcgcgcggcggcaccggctcgtccaccatggcccagaacctggcctgggcggcggcgcggcatctggcggagaaggtcattctcatcgacctggacatcgccttcggcacctccatcctggccttcaacctggaggccaagcaaagcgtcgccgatgccctggcccatcccgagcgcctggacgaggtcctgatggaccgctgcatggccgaatacgacgaccacctccaggtgctggcggcgccgggcgacggacgcagccgcgtggccatgtcctccgaggcagtggagcatctggtcgagctggcgtcgcgcatggcggcgctggtggtgctggacgtcccccatgtctgggcggagtggagcgaaggtctgctggccgccgccgacgaggtggtgatcaccgccattcccgacttcgcctccctgcgcgacaccaaggcgctgctggaactgctgtcgccgcgccgccagggcatggcggcgccgcgcctggtgctcaaccgggccgagaacggccgcaaggcgcaattgtcgtccaaggacttcgccgacaccctgaaggtggtgcccgccctgaccgtccccgccgacccggccctgttcggcgaggcggccaccgaggcccgcatgctggccgaggtctcggccaaccacaagatcgtccaatccctgggccaactggccgcgaccctcagcggcaaggccgcgccggtggggcgcaagcccaagggcctgctggactggctgaggaggtaggccatgttcggccgacgctcggctccccccgaccccaagtccgcggccccacgcgagacggccaaggcggcgacggcaacgcccctggcccagccggcgcccggacgcggagccgagcccgaccagcgcctgtccgacatcaagatcgccatcttcaacgacctgatcgattccgtggaccccaccgagctgggcaagctggaaccggcccaggtgcgcgaagagatctcggacatcgtcgccgagatcatctccatgcggaacctggtgatctcggccgccgagcagcaggtggtgatcgccgacatttgcaacgacgtgctgggcctggggccgctggaacccctgatcgcccgcgacgacatcgccgatatcatggtcaacggcgccggcaaggtctacatcgagaccgagggccgcatcgagctgaccgacatcaagttccgcgacaacgcccagctgatgaacatctgccagcgcatcgtggcggcggtgggccgccgggtggatgaatccagccccatctgcgacgcccgtctggccgacggctcacgcgtcaacgtcatcgtgccgcccctggccatcgacgggccgacgctcaccatccgcaaattcaagcgcgagaagctgaccctggaaaagctggtggagttcggctcgctgtccgccccggccgcccgcgtgctgcagatcgcctcggcggtgcgctgcaacatcctgatttcgggcggcaccggctcgggcaagaccaccttgctcaattgcatgacccgctacatcgaccagaccgagcgcatcgtcacctgcgaggacgccgccgagctgcaattgcagcagccccacgtggtgcgcctggaaacccgcccgcccaacctggaaggcgccggcgccgtgaccatgcgcgatctggtgaagaactgcctgcgcatgcggcccgaacgcatcatcgtcggcgaggtgcgcggccccgaggccttcgacctgctccaagccatgaataccggccatgacggctccatgggcaccatccacgccaacaccccccgggacgccctgtcgcgcgtcgagaacatggtggccatgggcggctattccctgccggccaaggcggtgcgcgaacagatcgcctcggcggtcaacgtcatcgtccaggcgtcgcgcctgcgcgacggctcgcgcaagatcacccacatcaccgaggtggtgggcatggagggcgaggtcatcaccttgcaggacctgttcgtcttcgaattcgagggcgaggattcgcggggtcgtatcctgggccgccaccggcccaccggcctgcgccccgccttttgggaccgcgcccgctattacggcctggagcgcgatctggccgaggccctgggagaggtccatgtttgaggccctcgcccgcctgccgcccgagatcgccgtgctggtggcggtgctgctggtcgccctggtggtgctgggctgggccttggtcagcctgattcacggcccccgcgccaggctgaagcgccgtctggccgcggtggccggcggccagacgtcatcgcgccggacggccgtccgcggcccccagcgcaaatcggtgcaggcccgcctgaaggcggtggagggctcgcgccagcgccatttcggctggcgctttcgggaacagctgatgcaggcgggctggcggctggaggtctggcagtatctggcgggctgcgccgtcctggccctgctggtactgggaatcggcgaagcttccggcctgcccctggtgtggagcggtctggccgccctctgcctgggactcggcatccccaagctggtgctgggcatggcggcgggcaagcgcctcaaggcctttgcctcccagttcgccgatgccctggacgtggtggtgcgcggcatccgctcgggcctgcccttgggcgagtgcatcgccatcatcggccgcgagatgcccgacccggtcggcgccgagttccgccagatcaccgagggcacccgcatcggcctgaccctgcacgaggccctgggccgggcggtggagcgcatgcccatggccgagatgcgctatttcgccatcgtgctggccatccagcagcagaccggcggcaatctggccgagaccctggccaagctgtccgacgtgctgcgcgccagaaagcgcatgcgcgacaaggtccaggcctatgccgccgaagcccgcgcctcggccgccatcatcggctcgctgcccctggtggtggtcggcatgctgggtctggtggcgccccagtacatcgcgctgctgttcaccagcgacttaggcaacatcctgctggccatcggcgtcggaaccgaggccatgggggtgctggtcatgcgcaacatgatcaatttcgacatctgaggagggcaggatgtttgttcgcactctcccctgtcatcctgagcgtagcgaaggatctccgtccggcacggcggttcagggtcgtaataggtggagcaggacgagatccctcctcccgatggtcgtcgggatgacgggccgggtgaagccatgctgaccaccctcatcatgctgacggcggccctggcggcggcggcgtcggtgctggccgtcgccctgccgctgctggcccgcgaccgccgggcgtcgcgcatcaaggcggtctccaaccgtcgccgcgaattgtccgagcgccagaaggcggagctggatcaggcccgcgccaccagccgccggcggggcgccaggccgcagcgccgcgtcgccctgatgcgggcggtcatcgaccggctgaaactgcaggacctgctggaggccaaggcgctccgggcccaactggcctgtgcgggctggcgcagtcaggcggcgccgctgaccttcatcttcgcccgcgtggccttgccggtgatcctgctggccctgggcctgatctacgccaccaccctgttcgacgagcagccgctgatgatccgcgccttgatcctggcggcggccatgggcatcggcgccctgctccccaatatctggctcaccaacgcggttcagaagcggcagatggcgctgagccgcgcctttcccgacgcgctggacctcatcgtcatctgcgtcgatgccggactgtcggtggagacggcgctgggccgggtcaccgaggaaatgatgatcagcgcccccgagatggccgaggagatcggactgaccgccgccgagctggccttcctggccgaccgccgccatgcctgggagaacttcgccgagcgcaccggcctgccccaggtcaagtcgctggccaccgccctcatccagtcggagaaatacggcacgccggtggctcaggccctgaaggtcatttcccaggaaaaccgcgagggccgcatggccgccgccgagaagaaggccgccgccctgccggccaagctgaccgtgccgatgatcgtcttcttcctgccggtgctgttcctgatcatcgccggcccggcggcgatccaggtgtcagggatgatgaagtaataccagcctgcgttgagtgaaactcatcgcgggttggataggcccaaagggccgcgcgccttatggcgcgggaggcaagggcgcggaggcgcccgccccgccgcgtgagggcgttgcggtgatcggtttcgatcaccgcgactggaataagcctgcccgcccgcggtgataggtgggcggcaagggatgcggcggagcgcatcggcgcttcatttccagggtgcaggccttgccgcaatgccggtccatttcatgcagccgccaccggcccggttcgaaccatttgcgggcgaacctctcggcctcggcccggtcggcgaatttcgcctcgtcgaacttcaccacgctgtaggcggtggcgccacggcccttgagccactccaccatctccatgagaaggtcgacctggtgcccgccccaaatattggcggcgccacggatgcaatatttcatgtctggtggcgtgcgctgcttggtcataccagttgagtgccgttgactgtgctttcgacacagtcatcctgccgaccaaggattatttatcacacgaccttattgaaacaactttcgccgatattcgccgattcggcgcaatcctggcggaatttgtgtcgcggcacgacacagccgacaccgtcaggctcagcgtcgcgccgaagccgccagggcgcgcaaggtctcggcattggccttggcctgctccggcgacaggtcgcgccgcgccatgcgctcggcctcggccccgttgcccttgagcgccagcagcaaggccagattctgacgcacctgggcggtggcggcgggcaggtcggcggcccggctcagggtcgccagcgccgcatccaactgtccggacagagcctgggacaggccgagattgttcagcacggcggcgttgtcgggagtgatctccagggccttggcataggcggcctgggcctcggcggcatggccctgggaatccagcgccacgcccagggtggagtggatatcccaattgcccggggccagaatccgcgcctcttccaggctcttgatggccagaccggcccggtcggcggccagataatccttgcccatttccagcaggctggctgcctcgcggctgttgcgggcgagatgagcctgcatcaggtcggccgccgcctgcccctggccggaatagcgcaggttgcgcgccagggcgacggccagcccgccgtcgtcgggccggcgctgatacagggtggacagatgctggacggcgccctgatagtcgcggccggcctcggccgcctgggcggcggcacgcaagctgggctcgacccccgcggacatgccgccgctctcgcccagccccccggtcagggagcaggccgacagcatcagggccagggccaggggcaggggctgagcggcaaaacgggctttcatgatccggactccgtgaattcgtccattgttcatagacctttgtgaagactaccactgtggcgcgcttcattcatgtctatgatggcggcgtcaccataaccggtcgaggcgcgccatgaaggcccggcaatccctgttcctgatgcttgccgccctgctgtgggccgcccccctggccgcccgggccaccgaggcgctggaaatccccctgggcggcgccacgctgctgcccatgcggggcgtcgcccgctcggtggtggtgggcaatcccgccatcgccgacgtcaccgtcgacgggccgcgcaccatcacggtgttcggcaaggcgcccggcggcaccaccctggcggtgctcgatgccggcggcggtgtgctggtgcagcgccaggtggtggttctggccggcggcgagacgtcggtgaccctgcgctacggcacgggcaagacctgggtcccgggcggcgccaccgccatcgtcgattgcggccccaccgcctgtgcccccgccaacaccctggcgggcgagagcccctacaaggccaaaggcgtcggtccggctccccgataatccttgtggatttgtgaccctcaccacggaatatgacgttcggtcatgtcatcatagggccctgatcacctcagaggcgatgtcatggtccgggctctgctgcacatgttgggaattctgaagcgcgaccggcgtgggtcggtgacgctggaatattccatcctgctgctgccggcgctgatgatcctgttcggcaccttcgagatggggatggtgatctttgagaattcggtggtggagggcgccacccgcgacgcggcccggcgcctgcgcaccggccaggcccagaccagcgccaaccccgcctccaccttccagcagacgttctgcgcctcgctgttcagcctctacaagtgctcgtccttcaccttcgacgtgcgcagcttctccgacttcaccaccatcgccctgcccgccccccagttcgacgcccagggcaacgtcaccaacgcccagttcacgccgggcggggcgggcaccatcaccacagtgcgggtgatctaccgccatgtcttctcgacgccgctgatcgggtcgctgatgggggccgggaccggcaacaccctgggcatcaccgccaccgccgtgttcaagacggagccctattcatgagcccggcccgcctcagacgcctttggcgcaaccgacggggcgtggcggcggtggagttcgccctgtgcctgcccatcatgatcaccgccctgctgggcaccgtggagatcgccaatctggtcaagagctatggcaaggcggtgtcggcggcccaaacggtggccgacctcaccgcccagtcgccgtcgctgaccaccgcccagatggattccatccgcaccgccgcccagcgggtgctcgatccgctggtgacaaccaccgccaatctgggcatcgacgtgatcagcgtcggctatgacgcggcgggcacaccgtcgcagctttggcgctaccagtggggggcggtgtcgggcagcccgtcgctggccggagccaagggcctgggcgtgcagggcgagagcgtcatcatggtgcgccttgcctatatctgcgtcccggtgctgcaccacatcgtccccagcaagaccttcaccgaactgtcctatacgcgcccccggctggtgcgcaagatcgccctcaacggggtgggaggctgagcatgatccgcaattcgctgtcccgcctgatgacgtgccgcaagggcaacatggccatcatcctggccatcggcctgttgccgatcatcaccaccatcggcctgggcgtggacgtggcccgcgcctatgcggtgaaaagccggatgtccgccgccctggacgccgccgccctggcggtgggctccagcagcggcaccgacgcccagctttccgccgtggcgcagaagttcttcgacgccaattacccgaccggcgccctgggcgcccatcccagcgttgccgtcaaggtcaccggcgacgtcatctcggcctcggcggtggcggaggtggacaccgtcttcatgaaggtggtgggactgaacgacgtgcccgtccatgccgacagcaccgtgaaccgccagatcgccgggctggaactggccatggtgctggacaataccggctccatgaccaccaacaacaatatccaggcggtgcgcgacgccgccaaccagctcaccgacatcctgttcggcacggccaccgtgcacccctatctcaagatcgctctggtgccctattcggcggcggtcaacgtcggctcggtagcacccagcctgatcaccaccggcgacacctacgcccccaacgacctgctgggctggaaaggctgcgtcgtcgagcgggcgggcgccaacggcgtgggcgacacctcggcggccacggcgccgtggacccgctacaagtggctgccggccgtcgacaacaattacgacgcgaccaaatcctccaccgtgctggccaacccgtccaacggcaacgcctccaccggtcccaacctgggctgcccgacggccatcaccccgctcaccaacgtcaaggcgacgctgacgccggccatcaacgccatggaggcctggagccggggcggcaccctgtcggatgtgggcatggcctggggcctgcgcgtcctgtcgcccgagccgcccttcaccgaaggcctaccctggggcacgcccaaatggagcaaggcggtgatcctgatgaccgacggcgacaaccagttctacaagctgaccagcaccaccggcggcaacaaggtcaacagcgcggtgaactcggattacggcgcctatggccgcctggacgaactaggccgcatcggcaccaccaacgccaccaccgccaagaccaccatcaacacccgcctgacctcggtgtgcaacgccatgaaggccaagaacatcatcgtctacacggtgaccttcacctcgggcatcaaccaggccaccaaggacatctacaaggcctgcgccaccgatgcctccaagtatttcgactcgccctcccaggacgaactgaaaagcgccttccgcgccatcgccaccagcctcagcaacctgcgggtcagccagtagacggacctcgccggccgggcactacggccgccgcgccctgaccgccgcagatgctggacataccgcaccgcgaggcgaagaaaccgtgcctacatcatttcccatggggcaaagcgcatcatgccgacttgagagcggcaaagccgaccttccccagccgcaattcgtcgatccgaattcgcgccgcggctggcgaaactcgaaactctttcgccatctcagcatcagaccggatgccctcgctccacttcctgcgaacgacatcggcgggcatcagaaggcctgccgcaaatcggttcgcctgcacttcttgttcgtcagaaagattggcactgcgatacatggcgttatccgtgaccccggttccaatcaaatcccgatgaagcacatagtgtgcgatttcatgagccaaagtgaagcgacgccggtttgcatggtgcttctggttaatcgaaactcggaagcgaccgcccgccacccgctcaattttgccagacacatccgggggaatctctgcatccaaggtgacgtccaggccaagagccctagccatcgcgtcaaggtctaccggcgcagaactcatgaagtcgctaacgatttcaattgcagaacgcttttcagcttgacgttccattttcctctccggcttcagcttgcgcgaaagcatcaccatgttccgactcgctccggcgaacctcccggaccgtagcctccgcaactcgggtggccaccgcttcggccttctcccccgcaatttcagtggctttcttttcggcagcttcgcgagccatttccttgatttgtgtatagccccacactgccgcaatagcgagcatgatggccaacacggcaaggatggcggtaaccgccgttaggatgattgagctactccccggaaattggacactgacggaagctacgatctgatgtttgctgatccccaactacgaggagatcagagatgtcgaagcgcaggaaccatgacgcggccttcaaggcgcgtgtcgcccttgaggcgctgaagggcgagcggacggtatcggaattggcgtcggcctatggcgtccatccgaccatgatccatcaatggaagaagtccctgctggacggggcggcggagatcttcgaacgcggggccaagaagaaggccgaggtggacgaggatacggtgcgatccctgcacgccaagatcggggagctggccgtggccaacgattttttgtctcgaaagctcaagccgtggaccggcaagtgaggcggaccatgatcgagcccaaacacccggcgctgtcgatcggcgcccagtgccacctgctgtccattgcgcgatcatcgttctattacgagcccttgggcgagacggaggcaaacctggagctgatgcggttgatcgaccgccaattcctggaaacgccgttctatggtgtccgtcagatggcttggcatctccagaacgagggccacccggtcaacgtcaagcgcgtccggcggctgatgcggctcatgggcctgatgccgatctaccagaagcccaacaccagcaagcccgccaagggccacaagacctatccctacctgctgcggggcctgcggatcgaccggcccaatcaggtctggtgcgccgacatcacctatctgcccatgcgccggggattcctttatctgatcgccatcatggactgggccacccggaaagtgctggcctggcgcatctccaacacgctcgaggccgacttctgcgtcgaggtgctcaacgaggccatcctgcgcttcggcccgccggagatcatgaacaccgaccagggcagccagtttacatccttcgcctggatcgaccggctgaagcgggccggaacccgcatctccatggacggcaagggccgttgcatcgacaacgtctttatcgagcgcctgtggcggtccctaaaatacgaatgcgtctatctccatgcctgggaaaccggctcgcaagcaagggccgggatcggaccctggatcaccttctacaaccacaaacggccccacgccgcccatggcggaaggacccccgccgtggtctactggaacaccatcaaccaaaccgatcagcaggcccggagagtagcttaaacttccccgaattctgtccaaccaatggggagtagctcacttatgtctcgcctcacctccttttcggcattttagcctccgccgatcagcctatcgcatcacctcgccgcccgtctcctctcactcggcatcacccacggcacctgatccagcgtccccatgtcgatgacctcgcgaccggaatggatcgaggtctcggcggcgagggccagcagcttgcaggtttccccggtcaggccctctgacatggcgtggatgcggccgatcagttccttcgagcggaagtcgctctcctgccgcaattcgaggctctgggcatagcgcgccacgaacagcgcgtattcccggctgacgctccagcgcggaatgccgatgggctcgaagcggttacccagttgctggtcggtctggaagacccggaccgcatcctgggtgcccatggccaccacgggaatcttcagctcgttgctgagactcttgaggctgttcagcaccatggagcgctgatcgaccttgccgattaggaaattgctgacctcgtcgaggatcagcacccgggtaccgacggcggccaatagctggagcagttggtcccatttggcctggggccgagccgtcgatcgatagggcgcacccaatgagcgcaggatcgcgtcgtagaggccgctgatatcagcatagggtggggcatgggcgtagaccaccgggcgcttgccgaagtccgggctgtcctccgccgggctgtgatcgcggacgaacttctgcgccagggccgtcttgccgttgttggtgtcactatagatcaggctgcacggcggccggaccaccttggggtggtcgtacagccaggccaagcggccgaggatcgcctcgcctgcctcgtacgcgacatagcggggactgcgaatgcggcggatgcggccctcaagctcgtcctgggggaaatccaacggcagcatgggcgccggattgagcgcgaacagatcgggcgtcaccattcttctacccccctcttgatctctgcatcgtcgaaatcgaaatcgttggacaccggcctgggctttggcggctcggaggtctggttatcgaccaccagggccagatggccgtcgcggcgccgcgtggccttgggcttcgccggcgattccggtggcgggcggggcgggtccagggtcagctcggcgcgatgcttgccgagttctcggttcttggcctgctcacgacgcacgcgcttggtctggcgagccgcttcggcggtgatgcggtgcatgtcctcgtaggcgtcgaagatcgcttgctcgttctcggcggccttgccctggcgcttcagccaagcctcgaccgcccggtaatcccacagcgagatcgacggccgcccgatgtcgcggtaaggaatctcgacgtagtcgttgagcctcggatccaggaagtagagcttggagatgtcggtcggatcgcggcggaccttgaacttccgccggcgccgaccttcgtcggcccggacccactgggagagcagcggatcgcggtaccagatcttgccccagacgatgccttcgggctgcaccgtgcgttcgataaagggcagaaagtccaggcgtagccgccgaggattggggatgggttcgggcaggccgataccccgaaaccggtcagtgcccatgatgccgtcgttccaccgggccaggggaggacagccgatcccgctgtggaccttgttgtggtagacgccgacaatgaggttgagcagccaggggcgcaggtcccgcagcgtcatctgggccttggcctctgacttgtactcgccgcgttgcttgggggtggagaaggtggcgccgggaagggcatggaccttcctcgccaaggttccggccaggcgctcgatatgaccgccgtaatggggcgtcttcggtggccggaattcgtagcggatatcgtgttcgtccagcgtgtcctggatcaggtagctgcggaaatccttgccgttgtcggaatggatcatgcggggcttgccccagaccggccactcacccttgatgcccaatcgctccagctcggcggccttgtccagcatgccatggcacaggcagagaccgacggcaaaggcgccgggattgtcgagcgacaggtgatagcccaccaccatgcggctgaagacgtcgatggccagcgtcagccacggacgtccgatgggcaggcgcatctcctcgtcgagcaccatgatgtcgagcagggtatggtcgatctgcaccacggccagcggcgcgtcggcaccgggaaaattgccctttaccgcgccgaacttgtcgtgggcggccttcttgccctcgcgccgcagcaccttttccttggggtcgatggcccgcagcctggcacgaaccgtctcggcgcagggcttggacaaattggccgcccggcaacggcgatgaacctccaggatgacctcctcgccgttggccttctgcgtagagaggtatttctcatcgatgacgctggcaatgatcgcctcgacctcaggtgacaggcgcttgggcatcttgcggccacggcgcgagggagcaaggtcagtcatgcgccgacgcccctcgtaccgtttgatccagcgatacagcgtcgcccgtggcacgccatgtcgttcggcggctcgctggacatcctcctcgcttcgacgctcacaacgcaccaacggcttgatgatggcgaagcgccgtttggcctcggccaagtcctcgggagccaatgcgtccaagctgcggtcggcctgggcggactcggcatccttgagcgatcgcagcttggagacgggcaccacttccttgtcctgaccatccccgatgtcgagcaggaccgaggatgccgtcaccgcctcgacgatggtgcagcgcttgccgcgccagagaacggaggcgccgggctgaaagctgaatccattgctcatggccgcgtctcctttgccagcgtgacgagactacccatggtcagggggcgatccaggtccacggctatcttgaattccgccaccatggtccagatgccgggcagaacttccggccggctcaagcccagcgcctcggccacctcgtcggcgagcgatacgacactttgggggccgcctttctgtaggactgcgcgcaacccttcccgcagaccggcggcaatggatcggcctcggaacggcagcaggaaggtggcgttctctagccggggcgtgcggacctcgcgttcggtcaccagttcgaagcgccagccatggcggcggccataggcgcgggcggcggcaaaccggccgtccagttgcccggagatcagcatgggatcggtggaatatttgatctcgaccagacgcggcaccggccggccgccgcgataggtcaccaggaagtcgggcacgtaggagcgggcacggccgtcggcatcgttgtattcgatccgcaccggctgctcctcgatgccgacgacggacggatcgaaacggcagagcagcgcgaaatcccgttccaaggtcgattccacctggacgccgggccgcccctgtcctatgggcacccgtccactgacactacgatagcaaaggccgattttgcgcacaggcatcgagtgtcccccatcacccttcacaaccaacgttagcgtcgagtgtgattgtgtcgggatcatgacgatcaaaaggtgttttgatggcgcagagcccaagcatccggcgaagtagggcatccagccatggccccacgtcttcgccagcacgatgtgcggcaaggcgggcggcggctttcacctcgggcgagacgccatccagcttccaataccgccctttgccccacggcaaaccgctggctacgggatcggcaactccacccatggagcccaacttggttccgcacagggcaaccagattctggcgactggccgattggccatggtcgtggagcatctgggccgccaccatgatctcttccgtggcatcgcccttgtgcggctccttcaagtgccagtccaccgcatgggcgtaggcgaagggatactcacccaccgagcgcttgcgcagatcggtgctggtcatgcccgccgccttggcggcctcgacaaagcgatgcggccattcggccagcaaccagtgggccatggcgacaagcacaccccgggcgcgcggggtcagcaaggcgccatcccgggcacggggaaggctttcggggcgaaccgcgaggcttggggcttgctcggccaaccagagcctcaaagcatgggcgtgcttgccgccggccagcagacggagcagttgggccaatatctcgagcaccacgaaggaatagaccggaccataatcgccgagatctcgccatccctcccggatcaggcccagcagatcgcgttgcaccgagatcgtgtcaaaagccggttcatccccggtgaagtcgcggagatcggcaccacagcccggacagcagatggcaccgcgcccgtcctggcgcaggatgctgaacggctcggcacaggagggacaccggtccagcagcaggcgcccatggatcggacatgtggtggaaaaggagagccgccagttgaggcgcaagtacggttgcgcatcggcccgcaggcaccaggggcagacctgctgaccgaagcagcggcgcccgccctcgcgcccggccggcggcagccataccagcttgttgaggccatcgtcgtgctcgaacaagcgcccagcccagcggcgaaaggtggcgtgcttcaggtcatcgaccggaacacccgtcttgcccgccagcaggtccagcaggcaatcatcggcatgacggtcgagatcgcggggattgcgatccccgccgggctggacgatgcggtaaagctcgcccggccgcagaccgttggcggctgcggttcgcgtgaaccatgaagatatcgactcatcgggcaacagcctggggtgccctggccagcgatcatcgagatgcatcggcccagcctccaaccgaagtggaggccgaggatcatagcgcgatcggtggccgagaggtgcgaggcagaggactcaccgggctgcgcagaggcttgggtttcccctgatcaaagggagcagcctatagacgagacgaatccggaaaatccaagtgaacccatgattcgtcatcgcgtcaccgaatggctctattcaggatgcccgtgaggcatcaaccatctgatttgacgcaagtttctgccaaggacagaaccctaatccgtcccgcttaaagctagggctgtctcagataaagcctatggagtcccacttaaaggcggaaccgacagaagtgtcggtttcgaatatagatcggccacagaggggctgatcaggcctccttgcggcctttaggccgaactgaacattggccttaaatcggacaaatgcgaaaatgaacctcatagttcggacggattttggccagagcctccctgcaaaataaggagctcgcctcaacccgcgaccaccaatagcgattttcacccgaaccggctgatcaacttcagacgcatctggatgtgccgcttgggagatggatgaggccatggagagaaagttcaggaagcacgccaagcgacttctcaagtcggcagccatgttcttcgccatccagcaagatgcaggcgagcgtgtccgcaagcagacgatggaggggtacggccgcctcagggatgctcacctattgctgaccggtgtcctcggttcggcgctgatcagggcgagcggactgaaggtagaactccgcgagggagatatggagcggaccgccctgctggcctcgtttgttatcgggatggacctatgcgagcgggctatcgccgagggccggcttctacaggcctgtgccctcgtgcggcaggagatggagaccgttacacagatgactgccatcgcggaagggagatactgcgacggcaggacgcccaacgtggcggccttggaagaggatctccgccggatgtacggtgccctaacggacgccgcccacgtctcgcggcattggattgtccggtcggccacggaatacgaaagcgacgccgctgacacgagctacacgcgccacttccccgccttcgaccgagaagcgtcccgagggctcttcgtcacgcacttagttctgatcgccagaatgttcggactctattcggcggcgaagggaaacgccgtctgcgacgaggaccgcgaggccgtccgccttgccttcgaccttatggagacggaggggatggtggcattggaggaggacgaggcctgacaggcccgccccctggggcgccataatctccagggccacagtaggtcagcccttgaccaccgcctcctcagccagctccccttcaaatgtctcttcgctagccccaagaaattccgccatccagcgcctaccttcgcggtctagctggttcaaaagcatgttggcgaccgcgtcgcggattaggctgcattccttgtacttgcgcccgctcccgcaggcacatcggtcattcctcctttgcttccttccgaccttcatggcgccctcagctttcccagtggggccggaagtgagttcccgaagcgggcgggatcaccagaaacatatcgtccagtggcttgcccccctttgcccggatggcacaccactgggtcgtctcgtcataggcccagctctggtcgggtgggctctcggggacaaagtagtggcaatagacgtattccagcggcttgacgcccggatcgaacgattgggcggtggcgaggatcttgcggtagcgggccctttcgacagcgtctccttccactgcctcgaacccgacatggacgacgcccggaagatcttcgggaagctggtcgttggcctccgacagcttcttgaggatgtcgcgcgccttcgcatcgatggccgcttcggaccggctctcccatcgcagcaggacggcaaggtcgcagtcgtccatgtacctcgggttccatgaagccggctgatgccgcatgatggaaacgtagttggttgtcctgacgtaagatccgctcaggagctcgtagacccgcgacccggacgactgaatgtcggagtgagcaagttcggctctgaggggggcgaggtccaactcgccgatagttccgctcccgaccgtgtcattccacaccaaaggccgacctcggcccctgagccagcggacaaccttctccgcgaggtagtcgctcggtacgctcgcgatctcgacctcgaagaccgcgttgcagaacacgctcatccccctgtcggcaagccattgcgcgtgcggcccccaaagctgacgcatggccgctcgctcgcgctctccgtacacgccggtctccatccgcttgcattccacggcccagactttgccgtccatccggacgtgcatgtccggcgtccgcgcgacgcccttcctttcagggatgaagtcgactacggcgccggcccttcggtaagcggcggctacgagaagctcgaacagcccaccgttatcgtgctcgtccagcgtgtcctggatcaggtagctgcggaaatccttgccgttgtcggaatggatcatgcggggcttcccccagaccggccactcgcctttgacgcccaatcgctccagctcggcggccttgtccagcatcccgtgacacaggcagagaccgacggcgaaggcgccaggattgtcgagtgaaaggtgatagcccaccaccatgcggctgaagacgtcgatggccagggtcagccacgggcgaccgatgggcagccgcatctcctcgtcgagtaccatgatgtcgagcagggtgtggtcgatctgcacgacggaaagcggcgcgtcggcgccggggaagttgcccttcaccgcgccgaacttgtcgtgggcggccttcttgccctcgcgcctcagcactttcagcttgggatcgacggcgcgcagccgagtccggatggtgcaggcgcacggcttggtctccagtttcgcggctctgcagcggcgatggatctccaggataacctcctcgccactggccttctgcgtggagaggtacttttcgtcgatgacgctcgtgatgatcgcctcggcctcgggagacaggcgtttgggcatcttccgccccttccgcctcggcgcgagatcgctgacccgccgccgcccttcgtacaatttgatccaatcgtagatcgtcgtccggcatacaccattttcctcggcgatcctgagaacgtccgcctcccgccgccgctcgcagcgcaccagcggcttgatgatggtgaaacgccgcttgacctcggccagatcttcgggaaccagtgcgtcaaggctgcggtcggcctgaacggtttcggcatccctgatgggacgcagcttggagacgggaaccacctctttgtcttggccatccccaacgtcgagcaagaccgaggaggccgtcaccgcctcgacgatgatgcagcgcttgccgcgccagagaacagaggcaccaggctgaaagctgaatccattgctcatggccgcttctcccttgccaatgcgacgatggtggtcatggtcaggggacgatccaggtccacagccacctcgaactccgccaccatggtccagattccgggcagaacctccggccggctcaagttcagtgccgcggccacctcatcggcgagcgacgcgacattcttctggccgccttttcgcaaggactcgcgcaagccatccctcaaaccggcggcaacggggcggcctcggaacggcagcaggaaggtggcgttctccagccggggcgtgcggatttccagttcggtcaccacctggaagcgccagcccaggcggcgggcataggcgcgggctgcggcaaagcggccttccaactgcccggacaccagcatgggatcggtcgagtatttgatctcgaccagacgcggtaccagccgaccaccgcgataggtcagcaggaagtcgggcacataggaccgagcacgaccctcggcatcaccgtactcgatccgcaccggctgttcctcgacggtagccacggagcgatcgaagcggcagagcagcgcgaaatcccgttccagggtggattctacctggacgccgggctgcccctgccccatgggcacccgtccactgacactgcgataacagaggccgatcttgcgtacaggcatcgagtgtcccccatcactcttcacaaccaacgttagcgtcgggtgtgattgtgtcgggatcatgacgatcaaaaggtgtttttgtggcgccgagcccaagcatccggcgaagcagagtatccagccatggccccacgtcttcgccagcacgatgtgcggcccgacgggcggcggcctttacctcgggcgagacgccatctagcttccagtaacgtcccttgccccagagccggcctgaggccacgggctcggccactctgcccatggagcctagcttagttccgcacagggcgactaggttccgacggctggccgactggccatgaccctggagcagttgggccgccgccgcaatctcttccgtggcgtcgcctttgtgcgactctttgaggcgccagtccactgcatgggcgtaagcgaagggatactcacccaccgggcgcttgcgcagatcggtgctggtcatgcccaccgtcttggcggcctcgacgaagcgatgcggccattcggccagcagccagtgagccatggtgaccagaacgcctcgggcacgcggggtcagcagggcgccatcccggacccgtgggaggctttcccgccgaaccgcgaggcttgagtcttgctcggccagccagagtctcagggcatgggcgtgcttgccaccggccaacagtcggagcagcagggccagcatctctaacaccgcgaaggaatagaccggcccgtattcgccgaggctacgccatccatcccggatcaggtccagcagatcgcgttgcaccggggcggtgtcgagcgcgggttcatccccggtgaaatcacggagatcggcaccacaacccggacagcagatggtgccccacccgtcctggcgcaggatgctgaacggttcggcgcaggtcgggcaacggtccagcagcaggcgcccatggatcgggcaggccgtgaagaacgaaagccgccagttgaggcgcaagtacggctgcgcatcggcccgcaggcaccaggggcagatctgctgaccgaagcagcgccgcccgccttcgcgcccggccggtggcaaccatgccagtttgttgaggccgtcgtcgtgctcgaacaagcgtccggaccagcggcggaaggtggcgagcttcaggtcttcgaccgggagtcccgtcttgttcgccagtaggtccagcaggcagtagtcggcatgacggtcgaagtctcggggattgcgatccccgccgggctggacgatgcggtaaagctcgcccggccgcaggccgttggcggcggcggttcgggtgaaccatgaagatatcgactcatcgggcagcagcctggggtgccctggccagcggtcatcgtcgcgcatcggcccaacctccatccgaaatggaaggccgcgaattatagcacgatcaggggaagcctgggatcgaacatggctcccggcaatgtatcggcttgaatttcggcaatggggccggaagcggaatggcgggtttcgggaggtggtggaaggtatgcagacatctgaattaagtgcagcggcaccgtaattccatggcttgggggtgagcttgataaactggcgtagctaggcgaggatgatggctgacacctccctcaaggcgtacgcattggacaaataataatcttgtcgatgactgaaacatgaaaacctttgtccccaacggccccatcttccctgaagagctgctacaggctcatgaggaaggtcgtctagtactgttttgcggggctggcatttcttattacaccggattgccgaccttcagccgactcgtggaattggcgatggagggatgcggcgttgccttcgaccggaaggaaaagcatcacccgctgcaccgggcgttcatggacgggaaatacgaccgtgccctgcaaatgctggaacaagcggccccagccatgcgcaccgaggtcatgggcatcctggaacagcccccgaagccaggtaccgaggatgcgccccttcaccgggcgttgctgaccattgcccgaaccagcgcggggcaaacgcagatcgtgaccagcaatttcgatgaccgctttgatcgggcggatgtgaatctgaggtggcaggcagggccgcgtctgggcattccacgtttggaccactggtccggtcccacttatctgcacggcaggattgaccgggcgcacgaccccgatgggcgggatttggttctgaccagtggcgatttcggaaaagcctatctgcgtgacgcctgggctgcccggtatgtggtcgagctgttccgggaattcaccgtactgttcgtcggctacagcctgaacgatcccatcgtcgggtatctggtcgatgctctggccgccgatatggggccgaatcgccagtttcgcaaagcctacgccttggctgaattcagtggcagcgacgtggacgagaaaaggcagaccgatgcttggcaggcaaagcacgtcgaaccgattctgtttcggaaactggggggaaagaacccatatcgattgctgaatgacagcttgctcgaatgggcgcgtcaccatgccagcggcctgggatcgcggattgacgaagcgttgacgctgggggccaagcccagccccaccaagatcgtcactcaggaagcccgcaatctggcttgggccttgtcaaaaggtgacggcagcgtagcccgtgctttcgcccaggccgagcgtgcgcccgatgtttcctggctggagcccttgtcccaggtcaaattgcaccaccccgccagtgggcaggattttggactgttcgattggcccagccccactgacaaaggaccgcatcttgcgcccctggctggcggaaggagctccatgctgccgctggccccggccacttgggaacttggccgatggctcagccgacacatgcggagccgagccctggtggattgggtcattgcccgcaacgggcgcgttcacccggactggcaatacttcctcgaacagaaattttctgaattgccagatgatgggacttggaagcctttctggcgcttgattctggatcacgccacgagcccgcaagtgtcccgatggtatttcagacccttggcccggcgtgaagacctgccgccaccaggatggtcaatggcgctgctggaggcggcacgcccttacctttccatccacaagccatttcaatggggacgggatgcctcggccccacccgagcagttgagcgacctcgctcgctttgagctgcaattggccgacgacgatttcgtgcagacggccttggacgccctggataagccggccttccaggctgaaatgctgggtgtcgcggaccaactcacctcccgtctggccgagggcatggaattgctccagcgcggcggcagctatatcggcggcctgtcggatcgcttttccctgatcgacccggagggacgcggtgttcagggatacaccccgctggtgtggctatgcgtgcgcatcttcatgctggcccgtgccgaccagccggatgtcgccgtggcattggcgcgacgctggatgaacctgtggcaggtcaaccggttgttcctgtttcgccgccttgcccttcatgccctggcttatgcgccggaactcccggatcgagagggattggactttctgttgggtaacaatcaagaggccctttgggcctatgattgcgaaccggaattggctcgtttcctgacagagcgtgtcccgcatttttcgtccaatacacgcgatgaactgattgcggcgattgtcgcgggaccacctcagcgggaataccggaacctcgacgccgatgatatcgccgcgatgcggcaaggccagatcaaccgccggcttgggaaattgcgccaggcggggctggatgctccacttccggcggatgcaaaaccggaagacatggcggatgcgcagcccgtccgtctgatgcggatcagccgggaagatgaaagcgcggcagccttgctgggcctacccccggaagaaactgtcgaggcattgctgaaccagtccggacgtttcaccgcttcgcggcaattggccgagttggccctggaaggccccgatcaggtgctcagctgcctgccgctgttggtgaaccaatgtccgccagactgggatggatggggcggtctcgctgatttggccaaaacagaaggggccgaccgctatctggacccaatcgcccaattcgtccaagaccacgaagcccatatcgccgacaccttgttgtgggctctggcaaatctgatccgcagttggggagaccgagccgttggcgaagaggcattccgcacttcttttcttcgcttgtgggaacggctttggcgcgccgcgcttcggcacgtcgaagctccatcggagatggaagccgtcaccaaggccatcaatgcccctggcggcatcctcgcggagacaatcactgacctgattctggcgttgcccgaggaaacgggccaagccgtacaaccctgttggggtatgacgatcgagggagaagaggaagctcaccttcacgggcgcatcattgccacctcgcgcctgttgtggctgcaccgcatgttcgcggaagcgacccgacagattttgctcccccgcatgatggccgcgcacgccgaggcccttggcctatgggaagggtatttctggggacgccactgggatgttcccttgatgcaggaactggttccggccttcttgtcgatggcagggcgctttcagaagcaggactgcaccgaagcctggagccagatgttcgcagacattctggtagaagcccccggcctgttcgccaaggatgacgtcgctcgggtcatgcgcaatgccagggtggaagatctgcgggccatggcctggcacttcttccaacgcttgtcgggagccgaagcaaaggcaggcgaactatggacaacagcaatccggccgatcatcggcaaaacctggccggcgaccatcgcccaaaacactcccgaggtggcctccgcactggttcaagtggcgctgcattgcggtccgcaatttggcgatgctgtggaaatcctggtccgacgcaaattgcttcgcccgttggggcggcatcatggacttttgcatgatctggaagagccggatgaaaaccagcccgatttctgcgccgattttcccgaagcggtcctgggcttgcttgatcaaaccacggacgcggatatcgcccactgggacgcccggagcctgcgcaccatccttgagcgactatcgaatgctcgccccgagcttgctcagacacctgcgtatcggaaattacatctcattactgagcggcatggccaatgattgccccgcttcagtaaggttttccgccaccttctggcggatagcctataagccggacgaatccgaaatcttcagcgtcaagccgacaatggcgacagcaggcgtcctctccggcgaattaccccggatgacgcagctaactgactgccctacaacgatttcgttggtgagtgagcgcctgaatccgtccgccctatggctgtcgccgtccggattaaagatgcaaaatccggcttaaagccgaaaccgacaagaaggcgttgattttgctgtgtggagatggctgggggactaggattcgaacctagactggcggagtcagagtttgtcggtactttcaataatagcagtaaaaacgatgcgttatgacacatgaaaaattactgctaacgaaactgctaattttcttccacttttctcaatgttttcattgccatagacgcttcagcagctcgctgcgacgcaatgcgtttgctctttgttcttgtccgattttgctcgttatcgtatgctataatgggaagtctgaccaccgaacgcggtggtcagcgacgaacatacagcatgtatgttcgtctattcacctgacatcccttgctctgtcgcggaacctttcgtagcctccttatcaaatagcgatgaaggcgttgcttgcatgacagacatggatacccttgattgggacgtgagccgcaacaaccgcccagattatcggcactggcgcaaggaccatgtaaccatcctccctgcgatacatagtagttacctgcaatattccgccaggaatgatgtcgccacaaagctacaagatcatggctttctctcgttcgccgatttcaactttctgagcaaggacgggctgtatctatatgatgcagcgctctacagcgcgggtggcgctgacctgaatgttgaaaagtcgagggagcttacccctggcatatgggatcgtcgtgacgacacgatgcttatgagcgatagcggcggatttcaggtgctcacaggggtttggacgccaaaagactattacgaaaagcgcgagcaaatcctgagatggcaggaggaaatctccgacattggaatcgccatggatgttcccagtggctgcgtcaacagccgcaaggccaaatccatcgagtcggtcgatgaagcacttttctggtcaaaagcaaacttcacatggcaggtaaaaaatcgcaatcccagcaaaatgcggatgctgaacgtaatccaggggctggaaattgaagggcagaacggtgttttgcgttggtatgacgaggtgaaggggtattgcgaccgccgccaatggggggaaagagcctttgacggctggtcatttgggggctatgccgcgcgagatacccaagccgctttgcgcgttatatcgcgcatgttgcaggatgggtttttgggcaaacatagcaaccatcgctggattcacgttctcggcgtcacttccgcaaagcgggttgctaccttcacgcttattcaaaaggcactgcggcaaatcctgggcgatgaggactttacggtcagttgcgattcatcaaatggctgcttcgcagttggaacaaaagggaattactacacggatggtgggaggggcattgtccaaagaaaagtgcttcatgcccaatggtttcagccaacctgcggaaaagattgccgcatctattgcacggcagacaatcctgactgtgggccgtgcatcgagcagcgaattcgcaacatgattaccatgtttggcacatccaccctgaatttccatatgccatttgaaatgatccttgatcttgtaaactacgatgaggctgggaggctttctcctttgggctacctggccttcatgaacatcagcatggaaatgttcctgcgctacgcttatcgcagttcaagcaagattgtggatgcaaaagcgggggtggtgagccaactcgttgcggccttaaagagcgaaacgcccgaaagcgacctagcaaagatcaagctggcctgagaggctaatatacatgctgtatgttcgccccgctttaaggcagctataaattttcaacggcggatcgcatcatctggtcgttgacctcgatgtagcgctgcgtggtggacaagtggcgatgaccagccagcgtcatgatcaccttggccgaaacgcccttgtgagccatctgcgtgatgaaccaccgccgaccgctgtggctgctcgcgccatcaatcccagccagcgcatatatctgtccgaatagttggcagagcgtgttggccgagaacgccgtggccttttgtgtcacgaggaacggcgcggcgcgatccgttgtcgtgctgcacgacacgaagcgttccagttcgcggcgcagcttaccactaacgaacaccgtcctggcctccgctgttttggtgtagctggcaggcagcacgatttggtccttcacgcgaccatcgccgtcaatcacatcgccaagtttcaaatgggcaatctcgccgacgcgcatccccgcataaaaactgagcatgagcgcaacgcggttacgcgctgcatgacgctgattggcgacaacggacagcacgcgcttcagttccgcttcgctgagtacctttgcttgcttcatcgctttacctaatgaaaagttatcccactaggtaaaaaattatatgatcaaaatcgcagcaggaccgaccgctattatctgcgttgataatcaagaggttatcgcaaaacataagaaaagctgtgttttcttatgttatggcgttgacgaagaaagcttggtcagttcgccctgatttttcgaaagggctgcgcgggttgtgttgatttgttcccgctttttcgccatggcggcggactgcttcagcttcttagcttgttcggacttcatatcggctttgagcttcagattgtccgcgaaggaatttggtgttgtgtcttctttgataacttcccaagctcgcatgtgttgtctcccgagatgtagtttgtccgcatgtatttatagcgagggatgactgcggctttgcccttaagatagcaggaggccgcaagcaatccgttctgtgtcaatcaattgattttcgtcttatcgatcagttggttagttcgactgcggctatttctacatatctcggcagcgaaaagctgaaagagagcaattcatctctggtagtgcttgggctactggaaactcgattggctatatctccaactcgtatttcatcgaatttatctgtttgatgatttctcgatctttcttttcccgagtcacatttctccccccactgccaaactacgggatgacacaaggcggtgtgtcctcgccggtgaacttcattgaagaagcgcctgacagtggggggagagatggacgtcttttccgtcgtcgtgttatttcgcatcagctaaggcggcacccgaattccttatctatagaagcgtctctcctgagccttacgctcagtgcggttatgcaattgcaagcaactacggcgacgcataacatccgcgtctgcgccaagtcctatatcgtgaactcaatccgtgtgcgttaatcgcactctcgcgccttggccgtagtctcagtcgtgcagcgtgctaatctgccgactgatcctttctgcgctggtttaaagttttccctcttacgtctcgaagttgcggtactgtcgtttcccgcactctatttattaagcgccgcctgcttcgttatatggacgttatgccaagccgtttccagccatatgtatttatctcggattgaggccaagttcgtaagaattttcaaaaatattttcgctactggtttcttgggcgtccaaagccccgagtgcttggctggcgcgtattgcctcgcgcactgcttcagtgatgggaacaacctggccgttgaagcccatctcgcagtatcccttgggtaaattgggcagtctgttcatggcgttttctcctcctggcggcagcgtccagcatggcgctgctccgcaagcgtatttagcgcggacggctaaatagcgggacgaaacgcactgaggaggaacggccatgctgctggagaagatctatggggaattgagggatatgtggatggtcgagagccaatatgaattctctcggttttggctcggtcagtcgcgcagttacatgtcctgcgccaaggcgcggcagcggccaccgtcgttgttggtgctgatgcggttgtcgcagcggctatcgtccatctcgtccaaatatgccgccgtggcgacgaccgagatggaacggggcaattgcactcggttagtcacgctgcgggatggggttgggaatgaaattgagcggctatcagcggcgaggtagctgaacatacatgctgtatgttcgtcgatgatgaacgccctggcatccctggcaaaattcaacctttacgcccatccgcaaatttgttaagtgaacgcaatggggtcgattaaatcgtgtagcgggggccttagacatcatcggtgttggccgtggttagaactggctgaatttgattgagcataatcatgctggtttttatggctttttctaagctaacaggaccatcaatgatgtttaataaaataaaggggcgcgtgcctgtgatgacctgggaaatatgcccaaggagcctttcaatctatgccataacattcgcaatggcaacgcaatcggccgcagcccagggcaatctccccgcctcagaccatccagggcggattgagaagcgatttgaacagccacgtaagctgctttctatatttgagcctatcattccggacagtcgtccatccctgaaggagagtgatcgcgtccgcattgccttggttggggtgatggtagagggtgccacaggctccaccaagcccacggacttctttcctctttattccggtctactcggaggggatgcctccctctccgatatttaccggatcgcggacgccatcaccggcaagctcaaagcggaaggacgtccgaccgctaaggctactgtgccgccgcaacaaatttcgggcggcattgtccggatcgttatcatgccggagaacggacagtgacatatcgccatcgtacatctcgcgctcttggtacaagcgtatgcctgaccgtgctggcaattgcccccagtgctatggcgcaagccaacttctctgccggagatgatcctggccggatcgagaagcggttcgagcagccacgcaaaccgcaatcggtcattgagccacaggcccccgaagttgacgagcaacttccgcccgaagaatctgacaaaatcattttcaccctgaacgacgtggccattgagggcgcgacggtctttcccgtttccgatctgtctaactttcatgccgacaaggtgggcaaggaagtctcgctcactgagatatacaagttggcggacgaaatcaccgccaagtaccgcaacgctggctatatactgtctaaggccatcgtcccgcctcagcgcattgcggacggcaatattgccctccgcgtggtggaaggccatgtcaacgaggtgctgattgagggagaggctaacggacgcgcagccctgttccacgaatggggcgagcggatcaaagaatccaagccccttgataacaaggtgctggaacgctactcgctcctcgccaacgacctgccgggcgtcaaggccaaggcggtcttgcgcccatccgagactgtgcccggcgcttctgacgtcgttttcatcgtcgagcataagtacgtggatatgtcggccacgttcgacaaccgcggtaccaagacaagtggacctcaggaatacaccctgggcgcgggccttaactctgttcttggtttgcacgaaaagacatccgtcaactggattaataccaccgataagagggaactacgttacctttccatccagcacgacgaggtgctgaactcggagggaaccaagcttaccctttcgggcaaccgtagccggggtgaaccgggcgagtccttgcgtgatttggagcaacgctcccgcaacgtcactctaagtgccgcacttacccacccctttatccgcaccagggcagagaacttctccctatccgcagggttcacatcgcgggattctcgctctgagcagttggggcagctatcgtccagcgaccataccagggctttcaagatcggaggatcctacgacttttcggattccttggacggcgtcaacctgttcgcaatcgatctttaccggggcatcgacgggttgggagccacgcgctacgaatacggcttgaagtcgcgggcgcgggggcgagccgatttcactaaattgacccttgatgcgtcgcgcacccagcaactgcccaatcagtttgccctgatcatcggtatgaccggtcaatggtcggccaatgccctgctgacatccgaggagtttggctatggcggctcgcaatacggccgcgcctatgattcgtctgagatcacgggcgacaacggcgtcgcgggcaagctggaactccagtacaccaatcaggtagaggatatcgggctaaaatactatcagccatttattttctacgatgccggtctcacccacgaccgtgacccggtcaatactaatgccgtccgtaccgggacctcggcgggcattggcatccgcttcggcctgaccgactatttcagcggtagcctggaaatcgacaagcccttgacccgcccggtatccgccaatcttcccggcggcaagggcaaggaaccgcgtttgttcttcagcatttcggcaaggtactaggcccatgagcaccaatctcgcccaacgctcagtcatccgccaatggctccgctccaccaccgccctggttggatgtcttcccatgctcggcctgacgatttctctggcccatgctaacccgcaaggtggcgcggtgacgcaaggctctgccacgatcagtcaacccgatcctaagactgtgcaaatcaaccaatccagtgaccgcgccatcatcgactggaaaagcttcagcatcgctgcgggcgaaactacccgcttcattcagccttcatcctcgtccatgactctgaatcgggtgacgggcgatcaggtgtcgcagattctcggcaaccttcaggccaatggccgcgtcgtcctggtcaatcccaacggcatcgtcttcggggcaggctccaagatcgatgttgcagccctgatcgcctccacggccaacatcaagaacgaaaacttcatggcggggaatctgcgtttcgacattcccggcaaggctaatgcccaaatcatcaatgaagggaccatcaccgccgccgatggcggtttggtcgccatcgtatcgccctacctccgcaattccgggataatttccgcccgtctgggcaaggtagcgctcgccgccgccaatggcgtgaccctggacttgtacggcgacaacctgatcctctttcaggccagcgacaagatcgccagccagatcgtcggagccgatggccagccggtcgccagcctgatcgagaatagcggcaagatttatgccgatggtggtcgagtcctcatgagcgccagcgccgcaaaaggcgtagtggataacgccatcaataccactggcctggtcagtgcccgtaccgtcgagcgacagggcggcgagatcatcctgaagggtggcgacaacacgacccaggtcacgggaaggctggacgtgtccggccttgatgccgcccaagtcggcgggcgtgccgagattaccggaaatcagctcaagatcggcgatagcgcggtggttgacgccagcggcggcgcgggtggtgggcgcatattggtgggtggcgactatctggggggcgaggccgacccctggattatgagccagttcggtatcgagcgcgagcaaacagctatcccaaatgccatgacgacaacggtcgcacaaggggctttgctgaaggccgacgcgaccgcggacggcaaaggcggcaaggttgtcgtctgggcagacggtcacacctccttcaccggcgccatctcggcgcgaggagccggcagtggtctgggtggcttcgccgaggtttccggcaagcgaacgcttgcctataccgggcgagccgatctgggcagcttatcgggccggttcgggacactgctgcttgatcctgccaatatcgacatttttggtacggctggtggcgggggagcctcaaccaatatcgacgtcaatgatggaacgtccggtgtgagcgaagctttgttggaagccgcatccagcaatatcctgctctatgctgggacacgcatctcggtccagtccaaccatacgttcggcgggggcgagatcaccctgccccagaatatcagcatcacaatgaaaacccgtaattcttcgggtagtggcgatgccgacggtttgatcagcttgtacgatccgggaactgctgcaccgggtgatgagacttatgtgggcctacggacccaaggaacgggcagcatcaacatctatgcgggacgtgacgccgggtcggatttcggtaacaaaatctcgaccgtcaacttacataacttgaccacagagttgggcaacatcaacatctataatgacgagttcatgaatttctacggcacctccatccgcacctatggcggagccattgtcatcaacagttccaacaaaatcatcccacgcgagaacatgtcgatccgaactgcctcggccagcggatcgaccaacggcgacgtaaccatcacctcgccgtcggtcagtaattcgttcagcaaaacaattaccgtctatcggaccggtaacgccactgtgtcggtcccgaactcgccgtcgttctcgatcaatggttccgggacgactacggcgaccacgaacaccagcgccggttcgctccaggcagccatcgataaatccaaccgcatttcgcaggatcgcagcgagaaggatcgctccgaaggcatttgggcctatgtggtcagccagggcattcaggatcaattcatgcagtacgcctccagtgacaaggggggctataagcaaagcattgaaaaacttgaggtctataagaattataagaatgcagatttcgttaaactatctgacgccgttgataatggcgttattactgctgacaagaaagatcccctgtggcgctccttatatgtgggagggaagccaaccgaagcccagaataaggttctgtttgaaaaatactctaatgagaattttgttggtatttttaacttacttcggtctggaagcttatctcagacagatcaggtctggaatcaaatcccatacaatgcgagagttgttgccgcgaaacttctatcaaccttagaagcaagtcagtctggaaacgccatttcagctaatgacgctatgtttcttgctatcgcccgtgaaatcgaaatgggcgcaacctcactatcaaagctaaagaaagtttatgacagttaccgcgctgcacctgagccgccacctgggccagatcagagtgtcggtgaaatagctgagaaaacaacagcttctgtcgagttttctggtgaatccaagatgacctttgcgttatcaggttctagccttgtcgagtataagctccaaaccttggctcaagagaaggccgaaggaattctgtcgaatgtcaaatctgagcttgagagtaaatttgggggggcattctatggaaatccaattgcaaattattattccagtcaggttgatttggtccagaaggtattttcaagtcaggtgaaaaaaataaatgagcccgcaatgataaacgccatgcagcttatcgatgctgcatcaggacacagtgaagactatggattcggggcagagcctcgctataatcttttaaaagatgtgaaatttgttacgtccaaggaaactgggtttaacgtcaacacggcctacggagcaaaggaggcatttaccagtgtcttatcaatcatagactccggaaaaaatgctgtatcaacagcatcagaggtaaaagaaattttgaaaacaacctcggatatcgcaaagacttttaaggaaggatatgacgcaattttttcggattctggagcaatccaaaatgccattaactctgataacgcccttaatgccgctcgctactggtctaatgtaaagacacctggagatcttggtgctgtttatacgatgtccactgctggccttgtcgagcattacacagacacagcaaagcaggaaaaaattctcgcccttacaaacctatacacgtctctgaagagtggtgagaaggttgttgccggtggggataagcttgtaaaggcgtttgaaaaactcgcggaaactgtaaccggcatggccgctgcggctgacatgcgcaaaagagatatcgtcaatctcgatatgaaagtttctggggctgaaaaggttgctgagcaattattctatcagcaggcttacctgcaaaacaaagcggagaaaggggagagcatatctagcgacatgcttgtaatggttcctgtaaaaaaaatacgggaggttggttactggccattcaatcgaaatcaagaatattatgatatcggagcatacaagcaaattcgggatgttccagaatactcttcctacctgcgatgacatcaatatttttgattcgtcgtcgattgctcgaatttttggcggggtgagagttcctccgcatctggcggctgttggcaagcagccgtaatgccagcggttagcctcctccattcctccaacaaatcctcctctcgttccttgtcatacctgaactgtcctgttttcatccactcgctcacctgagccacgaccttaccctgagcggagatgatgtcgtcaatgggaaccctgacgaaggattccatatcatcgagcagcatcttttgtgctcgctttgatatgttgtcgaaaaagcgcagcacggtcggcatgggggcacccaggaaggcgattcccagcatatccttgttgaactccctcagaatgcgctggagttcgaaatcctcaagggccttgagcttggcgaacgcctccgcaatcgcgatctgatccggggccagttcagcggggagttttcgtagcatcggaacaaggcgtttttcaagccaatccgggtcttcgggtcgcttgccattcaggtatgcggcgatttccttgtcgcaatcaccatcgtcaaatagctctccgaatgccccttcgacggtcggttcgcaatcgggatggcgatgacgaaaagcctcggtatcgagggcctcctccaaatccttggcggtcatgcgaagccgtggcggcaatgagaaccgagcgtgctccgccgtcgtcattggggcatagccgtcaagatgagcgacgcagccaacgctgagggccttgagcattccaaggcgttccgtggctatcgttctgatacgagccagccacaagcgtgacgccaagagcagcagcccagagcttccgatcaacccgaaggccatatgagaccaatcaacttgggcaaaagccagcgcacccgcagttccgatgacgccaaatgcagccgccgtgttggctgccattgcggcaaaactgagggtatcgtccatgtggcgttgctcgaccagaaggtggccgtcaagaagccgttgtgccgccttgacctcacccagccccaatgtggattggcggatgaaatcgatgaagggggccgacagccaaggaagatcacgcaacgcccggtgataatgaagaagaatgcttcgctcgggatgatcgcaatggggttcaagggctaaatcgcccttcatccgcgcaatagcccagaaatcattcagagcaatgagcaatgctcgggccgcttccggcgtgggggcttcacgacgcaactggcgcaatgatttgaagctggcacggatgtaattcattgaaggctctcacattcaatgtcattgagaaaacggagagtcaaactccgtatacgcctgatgccgcccatcagtgccaatggacgggatgaagacctcagccataaagctgcccttcttgcactgaacgcgcatcagcttattgacgagcgcgatggtcgtgctgccgccatccaccagtgccttcactgcgtcaatggcgggaagaatgtcctttgagccgagcacaaactcagtgacgaaccccgcagcgccaatgggcgacgagaaggtatgggtggtcacatcgcccttgctatcgagcacagtccaatctttttccgtgatgcggaacatcgtggtctttcgcgttccgtcgctgatggcttttaccaaccgctggtttgggtctttcttgctgatgccaagagtggattgcagccacgttgcgaaatccccttcgaccttggcttccgcgtcccatgcgttgatcagcttgatgcgagccatcttttccacggtggagacataggtaatcgtcgcgacaccgtccttttccgcaatgcggcggatatcagtgtggggaatcacatcacgccaatcccacggctgatctggggttttagccgagatggcggcgatgccagcttgatagtcggtgatggtgatttccactgccgcatcaatgccatcaatctttgacgggccagtgatggtgaatttggcaccatgctttcccagaatggcgagcctcttcatgcagcctatggcatttgccccaaaccagtatgtgccgactgggaggaagtcttggtgaggtagcgtggcggagaacatgcacgtgtcgtagctgccatgagatgcctgtatctcacagcccttcttgccgtttttgatccgcacgtttgcgtctttggggtgggcgactgcgccaacgctcaaaagggccagcagcttatcaagatcgttccgttccgcattcgttgccgtggctgaattcacgtctgtctttggcgcgtcaccgtgggaaatcaggaacttgtccagcaaggcttttgcgctgtcgtcacgttccgccaagccgagatagtgagcgacccccgcattatcaaaatagatagcggcgagctgcgttgtccctttgaattcaggcattttcgggagtgcagtccgcattcccttttgaagtttagccaagccgcttttcagctgttgctcgcgcctctcactggccgtccttctgcgctcaaccgcatcgggttctgcgtcacgcttttccttccacttcacccgagcagtttcgattcccccttcattcgcaataaattccgctacatcggcagcgctttcatgcgacgcataatccagcacggcgctataggtgctgatcgctttttgacggcgggctttgtcctttttctcgtcatccgtggtcggtgagcactcatccaacgacggatcgaagaatgcctttagagttggaatataagggctggcttttgttccccgagcggttgccctcaccttcttgttctcaagcaggtgcagatagggcggctttcccgcccaatcgcgatgaaacttgaatgcttgtgcaagggcggcataaagcgctgtggctttttcagcttgcgaggttgcttcagcggctactttatcgtcaaaagccttgatctcagcctcgacaacagcgagtgcttcctgaaagccctcgtcctcaacctcggacatgcaagccccctatccagcaaattgctcagccccatagtgcccatatgagcctggggaggcaacgaacatacagcatgtatgttcgtttgattgcgactgttgctcataagctgacaccttctttcggttgtcctcctcggccagcaggccatagcatgttcgttatgtgttcccgttggaggatgtgatgatgagtgcattggacaagctgaagctgagcgaaaagacccgacgtgctgtcgcggcaacgcctgaagggcgtctgcggcacaagctggtggaagccatcaatcagcagatcgctgctgcggaagcgatgcagaagggcgagggatttgaaattcggcgcaagcgctggacgaaggacggcgagggcaacaagaccttgcaagaccgactggtcaaatttcgcccctggtactggcaggaggccaatggggcgttcatgctggaagtgcgctacggcaacaagatcgtggagattaagccgaagaagacggccattgagatcggcgacgtggcggaactggttcccacgctgacgctggtgcgcgatgctgtggtcgctggcgaactggacaagcagttgactgcgatgaagggacgcttcggtaagaagctcgcttaaacgccaaacagccccgtacaagcggggctgtttccatgagtgcgaaattcacccctgattttaacagatggtggctgaacgatcgcaaaatagcctcttccgctggcttcttttgagtgcaaaattgctgtctcgtttttcgtgcccaaacagatcatgtttgcgcagatgaatgatgagcatagggcgcttattagccgcaatggctgagcgttaacattacaaaactatctcattgatctcttaaatgggggcaaaagtgaactttagcaatctctatactcgccacaagactctcattcacggccaatttgttgacaagacatggattgagtttatggaggctgctgataagttttctcctgcaatgtgggactggtcattccagtcaatagcggatattagctctgcaagagagttatcagctactgaggaggagcttgccattaattgtcttgtatatatttttgataatatcatatctgatatcaatggcggggcggagagcgagtggcatgactatagccacctcgcttttgtttggtgtagcgaccatgatattgacatggatattgatatcggcaagatcatcataagcccatctgatggagaacttccaactattgttctcgattagccatgacaatgcgttggaacttgtccgcgatgaagggacgcttcggcaagaagctcgcttaaacgccaaacagccccgtacaagcggggctgtttccatgagtgccgtactgctgggcagccaaatcggcggcgtgtacgacgcgcaaagggccaaagcgacggcggcctatatataaggtgcgcctgtcgtgtaacacgacactcactcggggtcttttggcttatcaatcatgtcggtcagcctgaacttcttgcgcttgcgcggcgcattgggatcgggcttaacaactggcgcgtcgggatcgtatgtcggtccctcgggcaaattggccttgctcaatatctccgctgcaagcgcgggattatccctcaaaagcgccaaaatggcatccgtgtccaattgcaccttgtcgtggatgagttcgtgcgaccgctgctttggctcgtcctgcccatagtgcttgcggatcatctccacgctggtgcccatgttcttcgccagcagccaaacgtccagcctgcctttgataaggcggtcagtggcataggtgtggcgcagactgtatggcgagaacttcacgccattgcggtcgtattccagcccgaccgtcttcagcagcgccgacacgcccttcgcaaagctcaatatgggcttgcccgtcttgcggtcggcaaaaatggggtcgctgggcttggtccacggcgaaaacgccttaatctggttcaaaatatcccatgttgcctcgctgctgaccgccgtgcgcttccccgtcttggtgtcgtcgcggatatgaacgtgggtttctctgaccacgccaacctcagccttgttggtgatcagttcgcaatccgcccatgtcagctgctggtgctctttccctggccgcagccctgtttcaaacatgaactccacgtaggcgcagaccatcttgcggtcggcctccaccaccaagcccttcgcgccatttatataggtgggcatggccgcaaggatgcgcttccactccgcttccgtgaacgcaggccgacgcgcagttttgcgctgttcgtcatcaatgtcggggatctgatcgcgcttcacccatccgcgcttacgcgccgaattgaagatggctttgaggatgaagatttcgcccgagcgctgcgtctgtgtcttttgcgggcgcttggccttgatgagcttgccgccgcgcatgtattcgcgagaagtgtcctttgcccctggcccttccgtccaatatgtcagccgccacagcttgtacgcctcaatctgctcctgcctgatagcgtcaatggccttgctttcaaagtagggcagcagatagcggtttatgaccgccttgttgtccttcatcgtccgttccgtggccttgcccgtcagaactgccgtttgcagatcttccaagtaggcgttgacggccagtttgaaggtgcggctgcgaatgggaatgccacggcggaaatcggcggtcagttcggcgtgcttctcgcgggcaacgtccttggcctcctccaagtcgcgcttgcctgtcgctttggtcacatagcctttcatgttgcgaattttgtagcgcgctgtccatgtctgcgtgcccatatattcgcgctgatagagcgccacagcgccgtcgaggatatgaaccacgttgcccatcaaagcctcgcaaacgctcaatttttgcggcgcagcgtgggaaaatccgcgctggacagcgtttgagcgctgctaatgtactgctaacggttttttgacacaatgagagcgtcgctgctcattgttaagtcgttgattttgcttgggaagcgatggctgggggactaggattcgaacctagactggcggagtcagagtccgctgtcctaccgttagacgatcccccaccagtctggctggtggtcgttcgaggccccggcgcaaccggggtgaccacgagaggcgcaccttctaacacagggcttcggtgggatcaatgcgaaagatcgccggagtgaaactcgtccgaaccggcgggaatccgggcatttccgggcacggggagagggtgcttcccagccgtggccgtttgggagtaacatccgccgccccgaattttgcagagttcccgcttttggcttacgcctcgtcgtctccgtcccgcaacacgccgatctatgccgcccttgatctcggtaccaataattgccggatgctggtggcgcgcccccagggccgggcgttcaaggtgatcgacgccttttcccgcgtgacgcggctgggcgagggcctcggcgccagcggcgtgctgtccgaggcggccatggcccgcacgctggacgccctggaggcctgcgccgagaagctggagcgcaaccgggtgggacgcgcccgcatggtggccaccgaggcctgtcgccgcgcccgcaacggcgccgagttcaccgcccgcatcaccgagcgcaccggcatcgtccccgacatcatcagccccagcgaagaggcaggactggccctgggcggctgtgcctcgctgctcgacccgcatgtgccctgggccttggtcttcgacatcggcggcggctccaccgagctggtctgggtgcagaactcgccgctgggacagcaggtgatgggcatccagtccattcccaccggcgtggtcaccctggccgagcaatgggcgcatgaactggcgtccaatgccggctatgcccgggtggtcgagcgcatcggcgcggccttccggcccttcgaagcactgcacaccatcggcggcatgctggccggcaacatggtgcagatgctgggcacctcgggcacggtcaccacgctgggcgccctgcatctggggctggagcgctacgaccgcagccaagtggacgggctggagctgggctttgccgacatcgccgccgtcacccgcaagctggcctccatgagccacgaccagcgcgccgcccatccctgcatcggacccgagcgggccgatctggtggtggcgggctgcgccattctcgaagccctgtgccgcttgtggccgctgggcaggctgcgggtcgccgaccggggcgtgcgcgagggcgtgctgctgtccatgatgcgcgaagacggaaccttgggagcgcgaaactgatggcgactggtggcaagaagagtgcgggccgcaccaccggctccggcccggccggcggatcgcgcaatctcaccgtcaaggtgaagaccgccaagcggcgcaagctgtcgtccaccttgtggctgcagcgccagctcaacgacccctatgtgcacgaggccaagcgcctgggctatcgctcgcgcgccgccttcaagatgatccagctggacgagcgcttccacatcttgaagcccggcctgcgcgtcgtcgacctgggcgccgccccggggggctggacccaggtggcggtggagaaggtcggcgccctgaagcccaagggcggcggcaaggtggtcggcatggacatcctggaatgggacccgctgcccggtgccatcacgctgcagggcgacttcctggccgacgacgcccccgaccgcctgaaggaggccctgggcggccccgccgacgtggtgctgtcggacatggcggcccccaccaccggccatccctccaccgaccacctgcgcatcatcgggctggtggaagtggcgctgcacttcgcgctggaggttctgacccccggcggcaccttcgtcgccaaggtgttccagggcggcacggaaaagacccttctcgaccagttgaagaagaacttcaccaccgtccgccacgccaagcccccggcgtcacgccagggctcggccgagacctatgtggtggccacgggctttcgcggctcctccgaatagcccgtcctcaatggatcagggcctcgctcaaatggctctgcatctcgcgcggcgtggcgtgggtcaggtccttgaccacctccaccaccaccatgcgccgggtcagatcggagatatgcttgcgcagctcgcccatcatggcgggcggagccaccaccaccagccggtcgaacttctgggcgaggacggcgcggtccaactgggccgccacgcggccggcgaagcggcacttctcctcgtcctgccagtcgccctcgtcataggcgtgacggccgatcccggcggaatcgaaggcccggccgggacggtcggtggtcatttgcaggttatgggcacgcgacggcgccgccagcatgtagttcagcgccggcacgatgtcgcggccgggaccatcgcagtgaaagaagcgggcgcgggttccgtcggcgacgcaaatccaggtgcagggcttggacatctgaccctccctctcggattggtgaactgggttcctcaccgcctgccattatagcaccaaagcgcctttgggcgcggcgggcatggcggcaatcgctcccgcacatggctttcgcggaggcgatgcttgagacgcggccccgaatgtgtatgatggcgcgccactaaccggaccccaccaccggaggcggcatgattatcaaggaagcccttacattcgacgacgttctgctggtcccggcggaatcctccgtgctgcccgcgcaggcggatacccgtacccgcctgaccaagtccatcgaactgggcatcccgctgctgtcggcggccatggacacggtgaccgaaagccgcctggccatcgcgctggcccaggatggcggcatcggcgttatccataagaacctcgacatcgacgcccaggccgccgaggtccgcaaggtcaagaagttcgaatccggcatggtggtcaatccgctgaccatccaccccgaccagaccctggccgacgcgctgcgcctgatgtcggattacaagatttccggcattccggtggtcgagcgcggctcgggcaagctggtgggcatcctcaccaaccgcgacgtgcgctttgccaacgacgccgcccagccggtctacgagctgatgaccaaggacaagctggtcaccgtgcgcgaaggcgtcgacaaggaagaggccaagcgcctgctgcaccagcaccgcatcgagaagctgctggtggtggacgccgattaccgctgcatcgggctggtcaccgtcaaggacatggaaaaggcccaggcccaccccaccgccgccaaggatgagaagggccgcctcagggtcgccgccgccaccggcgtgggcaccgacggcttcgcccgcgccatgaagctgatcgaggccgaggtggacgtggtggtggtcgacaccgcccacggccattcgcgcggtgtgatcgacaccatcgccgagatccgcaaggcctcgccccacatccaactggtgggcggcaacatcgccacgccggaggccgccctggccctgatcaaggccggcgccgacgcggtcaaggtgggcatcgggccgggcaccatctgcaccacccgcatggtggcgggcgtgggcgtgccccagctttccgccatcatggaagtggccgaggtggcgcacaagcacggcgtctcggtgatcgccgacggcggcatcaagtattccggcgacatcgccaaggccatcgccgccggcgctgattgcgtaatgatcgggtccctgttcgccggcaccgaggaaagccccggcgaggtgttcctattccagggccgctcgtacaaatcctatcgcggcatgggctccatcggcgccatggcgcgcggctcggccgaccgctacttccaggccgaggtggacgacaagctgaagctggtgcccgagggcgtcgagggccgcgtcccctacaagggtccggtcaccaccgtcatccatcagatgatcgggggcctgcgcgccggcatgggctataccggcaacgccaccatcaaggacatgcagacccgctgcaccttccgccgcatcacctcggcgggcttgcgtgaaagccatgtccacgacatcgccatcaccaaggaagcgccgaactacaagagcgagtaggaccggccctggggcgccgcccgtcggcgcccccttactcctccggccggaaggcctcggcgggatcgtcgccggggaatttgatcaggctgagcagaaccgggctcatggggaaatccagcgccgcgttcatgggcggaatgggcgactggaaccacttggcgtaaagccgccccacctcgcccgattccatcatcgccttgaccgtgcggtccaccagcgccttgaactccgggtcccccttgcgcagcatgatggcgatgggttcggtgttcagggtctggggcaggatctggtaatccttgggcgccgccgaactggcgatcagtccggccagcaggttgtcgtccatgacgaaggcggcggcctggtcgctttccagcatcttgaacgattcggcgtggtcgttgccgaacagctcggtgaccttgatgtcgcggccctggacccgggccttaagcaactgcacgctggtgctgcccgccgtggtggccaccgccttgccgtccagctgggacaacttaccgatatgggcggcctttttcaccgcgatgcgcaccgaagccacgtaagtggtgggagcgaaggccacctgggtctggcgcgccgcattattggtggtggaaccgcattccaggtcgatgccgccgtccagcaggcggggaatgcgggtcttggaggtcaccacctcggttcgcacctcaagggcggccaggccgagctgggccttcaccgcctcggtgacgcggcggcagatgtccacatggtagccgatgggcttcttgtcgccgtccaggtaggacagcggataggacgcctcgcgcacgccgaggaccacggagccggttcgcttcaccttgtccagggtcggctcggcgcgtgcggcgccgccggtggaaattacggccagggccaggaacagcggcaggacgaaaggcttcatcgcgacgggtccgtaagattatttcgcgaaaactagatacccggtccgcgccgctgtcaacgtagccgagggtacaggggggtatgcggggcttgcagccacacccgaattgccgcatgtatcaggttatgactcccgccgcacgccttcaggccgccatcgaggtgctttccgaaatcgagaagtcggccaagccggctgattcggtcgcatcattctatttcaagcagcgccgctatatcggcgccaaggaccgccgcgccgtggccgaagtggtctggcgcgtcctgcgccgccgggcccgcatcgactggtggctggagcatctggaccatcccgagcgccccaatgccgagggcaagggcgggtcccgcgcccgggtgctggccgacatgatcttcgaaggcatcaagcccgagcccgacctgttccgcgggccgcattcggcctatccgcccgagccgcccgagcgccgggtgctggacatgctggccgggcagaagagcctgttccatcgcgacatgccgccccatgtgcgcggcgaatatccccaatggctgacgccgcgcctcgccgccctgttcggcgacaacctggattccgagatgggcgccatgcgcgacgaggcgccgctggatctgcgcgtcaacaccttgaaggcgacccgcgacgaagccatccgcgccctggccaaggagggcatcaaggccgagcccacggcgctgtcgcccatcggcctgcgcctgggcgcccgcgtgccgctggtccaggtccaggcctggcgcaacgggctgatcgaggtccaggacgagggctcgcagctggtggccctgctgaccgaccccaagccgggacaggcggtggtggattattgcgccggcgccgggggcaagaccctggccctggccgccgccatgcagaacaagggccggctggtggcctgcgacgtggccgagtggcgcgtcgaccgcgcccaggaccgcctgcgccgcgccggcgtccataacgtcacccgccgggtaatcgaaggcgaatccgacaagtggatcaagcgctcggccgggtccttcgaccgggtgctggtggacgcgccgtgcaccggcaccggcacctggcgccgcaaccccgacgccaagtggcagttcagcgagaccgacctgctggaactggtggcccgccagggcgccatcctcgacagcgcggcgcgcctgaccaagccgggcgggcggctgatctacgccacctgctccatcatgcgagaggaaaacgaggaccgcatcgaagccttcctcgccgcccatcccgattaccgcccggttcccgtgcccgaactgtgggccgaactggcgggaaccccctgccctgtcggcggcccctggctacggctgtcgccccaggcccacggcaccgacggcttcttcgccgccgtgctggagaaggcgcccgcataagaaaagggccggctccccaagggaaccggcccgaagtcttccgggaggaagaaaactagcggcgccaggccagatcggcgatctcgcggtggtcaagcatgtccatctcgcgctcgagccggcgggcggccctgaagtcccgaaccagcgcgatggcgcggcggacggcctcggtcaggcggaagtcgacgtcgaaaccggcggtctgggtgagctggtgcagggtcatggcggtcatcccggtcttgggtgttgatctgttgccaacaccctacgacgccccccgcaacccgagaatcgaccaattcgcatgggccgatgcaaaaacggcataccggtaccgaattaccaaataaccctactgttatcggcaccattccaatctagctcatttaatgaagtcttatggaatccgggaccataagtgggtgttgcaacgatggccggcagaatcgccggctcaaattcaaagcccttcagaatgaaccggacaagaatcctcgttacgggtggagcagggttcgtcggctcgaacatcgccatggcgctcaagcgcgacctggacggtgtcgaggtggtggccttcgataatctcaaacgccgcggcagcgaattgaccctgggacgcctgcgcgccggaggggtgagcttcgagcacggcgacgtgcgctgcgccgaggacctgggggcgctcggccccgccgacctggtgatcgaatgctcggccgagcccagcgtccatgccggctatgacggcaatccctcctatgtggtcaacaccaacctgctgggaaccgttaactgcctggaatatgcacgccgccatggcgccgacatggtgttcctgtccaccagccgggtctatcccatcgctgccttgcgggccatcccgctggaggagcagggcgaccgtctggtggtgccgcccggcgccgccgggccgggctggtcagaagcgggaatcggcaccgacttccccctgtcgggcagccgctccatctatggcgcaaccaagctggcgtcggagctgctgatcgaggaataccgtgccctctatgggctgaagatcgccatcaatcgctgcggcgtgctcaccggcccctggcagatgggcaaggtcgaccagggcgtcatcgtcctttggatggcgcgccacgtcttcggcgggccgctgggctacatgggctttggcggccatggcaggcaggtgcgcgacatcctgcacgtggacgatctctatgatctggtccgccttcagatggccgatccggacggcttctcccaaggggtgttcaacgtgggcggcggccccggcgtctcggtgtccctgcgcgagttgaccgggcattgccgccgcatctcgggcgggcaggtggttctgggctcggacccggaaacccgcgatgccgacgtgccctattacgtgaccgacaacgccgccatcacccgggcctgcggctgggcgccgcgccggtcggtggaaatagtgctgggcgacatccacgcctggctgctggaaaaccgggccatgctggccccgatgttcgcctgagcggatcggagttaaccggggagagatcatgagtgtcgtcgtcatcacaggatcgggcgggctgatcggtgccgaggcggcccgtttcttcgatcgccagggcatgagcgtgatcggcatcgacaacgacatgcgcggatatttttttggcgcgacggccagcaccgcctgggcgcgggccgagctggagcgcggcttgaaggactacacccacgccgccgtcgacatccgcgacacggcggccatcgacaccctcttcgcccgctacggcaagaccatcaccgcggtgatccacaccgccgcccagccttcccacgactgggcggccaaggagccgcaggtagatttcaccgtcaacgccaacggcaccctggtgctgctggaagccacccgcaagcactgccctgacgcctgcttcatccattgcagcaccaacaaggtctacggcgacactcccaacaccctgccgctgatcgagctggaaacccgctgggagctggattccagccacccctgggccgaacacggcatcgacgagagcatgtccatcgacgccagcacacattcgctgttcggcgtatccaaggtggccggcgaccttctggtgcaggaatacggccgctatttcggcatgaagaccgcctgctttcgcggcggctgcctgaccgggccgggccattccggcgcccagcttcacggcttcctgtcctatctggtcaggtgcgcggtgaccggcgacgcctatacggtcttcggctacaagggcaagcaggtcagagacaacatccactcagccgatctggtcaacgctttctggcatgtgttccaggcgccgaaatcgggggccgtctacaacatgggcggcgcccgacactcgaactgctccatgctcgaagccatctccctgtgcgaggagctgaccggtcgccccatgaactggtcctattccgagaccaaccgtatcggcgaccatatctggtggatcagcagtgtcgagcgcttccgcgccgactaccctggctggaatttcacctacgacatccgccgcatcctggccgagattcatgatgccatggccgaacggaccctgcggacacaaaggaaggcctgatgttcgcctatgtcgacagcgccctgatgaataatcttgggcatcacgcaaattcagcgcggaacatctcgactgagttgcggtcccgcggcatcccctgcgccgtgctgggctatctggagctggaacctgcgctgaaggatgaactggccgcggcgccctggttccgctgcaatacctacggcatctatgacaacgaccccatttgcggctggctggccaatttcgatttcgtgtcacgcgtgctggccgacgacatgaaccggattcaaggcattgcggccaccgatgtcatctatgtcaattccgtccagccgccccagttcatgggcatcgtgcgctgggcccaagctttgccggaagaccggcgtcccacggtgatcgtggaattcggcaccgatcccggccttgtggcccacgacacgccggaaggactgcgattttcccccatggacacaagagtggattcgcgggccgttctgctgcgctacacggcccggcacctgagcgaagcggatcagaagtggctgcgcctggccaccttcgacactcagtcctccgccatctttcagttattgctggactttcccgtcggcaccttgcctctgccgcagcaggcgatgacctcatgccgcgaccggagcggaacacgccccatcaccatcggcatcctaggccatcagcggggcgagaagggcttcgacaaggtccccgcactggtcgcccgcctgctggccgagcgcaccgatattcgggtactggttcataacggcttgcccgagggcatggtcacgcctcagcaggaattgcgcgccatggccgccgccgacccgcgcctgacgctggacgagcgcaccgccgacggcgtgctgtgggcgtcgctgctggaccagaccgacctgatcgtctgtccctacaaccgaaaccggttcatctcgtcctattcggccgtggccagcgaagccatggccaacgccattcccgtggtggtccccgaaggcaccaccatgcatgcggtgatccgtgaattcggcgagccgggaaccatattcaaagaggaaagcgtcgaggccatcgccgcggcgacccacgcagccctcgacgatttcgaccgcctggcggaattggcccgtcaggcgtccatccgatggggggaaacgcgcggcgccaagtgcctcgtggacaccttgctgtcctggcaggcggcatcttgaagaaggactagatccatgaaggttctgttcagcaatcctccgtggtggggcgaaaaggccctctaccccatgcccgacggttcccaccagctggtgcaccgggccggcgtgcgcgccggatcgcggtggccgttcaccttcttcatgggcaacggccccgacaattaccaattcggctcgtacctgccctatccctatttcctgggccacgccgccacctgggccaaccgcgagctgggcggcaacgtccagttccgcgattccatcgctttgcgggaatcctacgacaagtactacgagttcctggacgccgagcgcttctcccacatcgtcatcgaatccgcctcgcccagctgggagcacgacaagggagtgatcggcgaaatctcgcgccgcctgccccatacccgcttcgtcatcaccggccccatcacgtcccatggggaggcgctgctggacgaggcccccaacatccaggccaccgtgcgcggcgaatacgagaagggcgtcatcaaggcgctgaacggcgccaacggcgtggtggatttcgatctgctgagcgtggccgagatgaattcggcccccttcccctatttcgacaacgtcatcgcccaccgctattgcgacaccaacccgcggggccagcaattcccccatgcccaggtattgtccagtcgcggctgcccgtacaagtgcatcttctgcgtctggccggcaaccatgacctccaacgaccccgacggcagcggcaagcgcatcgtgcgccaatacagcgccgattacatggaggccttcctcaccgaactggtgcaaaaatacggcttccgctccatttatttcgacgacgacaccttcaacttgggcgatcgtcacgtggagaaaatgtgcgcggtgatgcgcaagatcggcgtcccgtggtcggccatgtgccgcgccgacacctccagcttccatctgtggcaggagatgaaggacagcggctgtttcggggtcaagatcggcttcgaaagcggcaaccaggaggtggtcgacaacatcgtcaacaagcgcctcgatctggaagaggcccgcaaggtcgccttcgaaatcaagcgcgtcggcatgacgctgcacggcaccttcactttcggcctgccaggcgaaacgcccgaacagatgcaagataccgaaaactacatgaccaccttgccgctggattcctgccagaaatccggctgcgccgagatcgagggcgcgccgctccacaccctggggcgcacctccaacctcaaggcctatcccggcgccaagatggacgaaaactacagccgcgagaccgacggccagatgaagttcgagaaaatgaggtccatacaggtttgacccgacatactcacatccaggcctcggcggcggcaggcaaaaagtattggcccttgctttgccgccggcggaatcccgcagattccaatgagatgcgccgaatcgatcagccataaattcgttgcgtcgaggcctgcattttggtagttaattaacctgagtggcaatatgttttaagcgagcgagcgtccgaagcggcgcgtaaatctccagaaagggggtagccgtggtttcttcagtcaccttccagtcggccgcggccattgcggcactgacgacgacgaacatcgcggcgtgggacaccacggacatcgcggcactggtctccacccagctgcaggcgctgaccgccacccagatcaaagctctggaaaccaccgacatcgcggcactgaccacgacgcagctcagcgtgctgagttcgacgcaggtcgcggccttcgacaatacccagatcgtcttcagcgcggcccagctcggcgtcctcaacgcctcgcagctcggcgcgttctcgacctcggacatcgccgccctcagcaccacggccatcagcggcttcaccaccacccagctgtcgtcgctcgccagcaccctgctggattccatcgaaaccaccgacatcgcgctgctcaacaccactcagctctcctcgctcaagacctcgcagcttgccgctctgtcgaccaccaatctgaatgcgctctccaccacggccgtggccggattgagcgccgcccaggtgaatgcgctgaccaccggccagatcgccgccctgtcgacgacccagaccgcgtcgctgtccaccgccgaactgaacaacctgacctcgacccagattcgcagcctgaccaccacacagctgtcgagcctgaccaccacccagttgtccggcatctcggttgcccagatcgccaacctgaccaccacggcgctgaacgctctgtcgaccaccggtctggcgggattgaccagcacccaggccaacagcctgacctccacccaggtcggcgggctgaccaccaccaacctcaatgcgcttgagactaccgatctcggggcgctgtccaccaccgcgctgagcggcctgaccaccacccaaaccggcgcactgaccaccacgtcggtttcggcgctgaccaccaccgaaatcggcgccctgacggtgacgctgctcaacgcgctgtccaccaccaatgcggcgacgctgacctcgacccagatcaccggcctgaactcggcccttctggctgggttgtccaccaccaacctgtcgtcgctggccaccaccacgctggcgtcgctgaccacgctgcaactgcgcggcctgaccaccacccaggcctcgtcgctgagttcggcccaggtcaccaacctgacatcgacgcaggtctcggccctgacggctcaatcgatcaatgcgctgtcgaccaccgcgctgaacaccctcagcaccacccagttgggctcgatcaacaccaccacgctgagcagcctgaccaccaccacgctgaacgcgctgcagaccgccagcatcgccgggttgaccagcacgcaggtgcgcggcctcagcaccgcccaggtcgccggactgaccaccacccaggtcaacgcgctggaaaccaccgacgtggcggccctgaccaccggtcaggtggccgccctgaccaccttgcaactgtcggcgctgtcgtccaccaatgcctcggccctgaccgccaccgaaatcaagtcgctctccgccgtgcaactgtccgccctggccaccacggcggccgcggaattgtccaccacccaggtggcggcgttcaccagcggccagatcgagggcctgtccaccaccatgttcaacgcgctgtccacctccgccgtgggcagcctttccgcgactcaagccaagagtctgacctcgaccctgctggccgggctgacctcggccaatctcggcgcccttgattccgccgatctggctgccgtgtcgaccacggctctgaacgctctgaccaccaccaacgtggcgctgctgaccagcacccaggttacgggtctcaaggcgactcagattgccggattgaccaccaccaaactcaacgcattgaccaccgccaatgtggcggaattgctggtgacccaggtcaaggccctgaccaccgcccagatcagcggcctgtccaccaccgtgctcaacgccctggaaaccaccgatgtcgccgcgctcagcgccgcgcaggtggcttcgctgaccaccacccaggtgacggcgctgaactccacccagatcggtgcgctgaccgctaccgagaccaaggcgctgtccaccacccagttgaacgccctgtccaccaccaatgcggccgagctgtccaccacccaggtggccagcctcaccaccgcccaggtggccggcctcagcaccaccaacctcaacgccctgtcctcgaccgcgttggcggggctgtcgatcacccaggtcaagtcgctgtccaccacgcagcttggcggcctgtccaccacccaggtcgacgccctggaaacccgggatgtcgccagcctgaacgcgacccagatcaatgcgctgtccacctccagcatcgctgaactgtccaccgctcagatcgacgccctgaccaggacccaggtggcgggcctcagcaccacgacgctcaacgccctggaaaccaccgacgtggccgagctgtccaccacgcaggtgcgcgccctgaccagcgctcaggtgggcggactgtccaccacccagctcaacgccctggaaaccaccgatgttgccgcgctgctcggcacccaattgacaggtctatccaccacccagttgggtgatttgagcaccacggtgctgaccagcctgaccagcactgcgctgcgcagcctgaccacgacccaggtcaatgcgctgaccaccactaacctggcggagctgtccaccacccaggccgcagccctgaccaccgcccaggtggcgggtctgtccaccacgacgctgaacgcgctcaccaccaccaccatcgcggcgttcaccgccacccaggccaagactctgacctccacccaggtggctgggctcaccaccacccaggtggcgtccctgtccaccactgaaatcgccgcgctgaccaccacgagcatcaatgctctgaccaccaccaacgccgctcagcttaccaccgcccagatcgatgccctgaccaagacgcaggccggcggcctcacgacgacgacgctgaacgcgctgaccaccaccaacatcgcggagctttccaccgcccaggcgcgctcactgacgtcggcccagatcggcgggctttccaccacccagttgaacgcgttcgagaccacagacctggccgccctgaccgccacccaggtcagcggtctgaccaccgcccaggttgcggcgctgaccaccacccaggcaagcgccctgacctccaccgagaccagggcactgacctcggctcagcttaatgccctgaccaccaccaacatggctcagctgaccagcacccaggtcagtggcctgaccaccggccaggtggccaatctcagcacgaccaacctcaatgccctgtcaaccaccgccttggcaggtttcagtgccacccaggccacgagtctgtccacgacacaggctgccgcgctgtccacgacgtcgctcggcgcccttgaaaccagcgatctggccaagctgtcggccacggtgctcaacgccttgagcaccaccggcgtcgccggattgtcctcgacccaaatcggcggattgaccaagacccagctcgtcggcctctccacgacccagctgaatgcgctggaaaccaccgatctggccgccctgtccagttcccaggtgcgcagcctgaccgccacgcagattggcgggctgagcaccacccagatcaatgcgtttgagaccaccgacattgcggcgctgaccgcaacccaggcccagggcctgtccacgactcagatcgccaacatcagcacgacccagttgtccagcctgactacgaccgggctcaaggctctgacgtcggcccagttgaacgcgctgagcaccacctccgcggcggaactgaccaccactcagattggcggcctgaccacggcccaaatcgccaacctgtcgaccaccaacctgaattcgctgtcgaccaccgccgttgccggcctcagcgccacccaggccaagagtctgaccaccacccaggtggcggccctgaccaccacccaggtgagttcgctgagcaccaccgaactgggtgcgctgagcgccaccgtgttcaacgccctgtccaccaccaacgtggcccagctgtcgtccactcagcagggtgtgctttccgccaccgtgttctccggcctgggcaccacggcgctgaatgcgctcgacaccaccgatgtcgcggcgctgacgacgacccagctccgcagtctgaccgcgacccagatcggcggcctgaccaccaccactttgaacgcgctcgagaccacggacatctcgtccctcagcgccacccaggtcggcggcttcaccaccacccaaattgccgctctgaccaccaccaatgccgcggccctgacaaccaccgaaattcgtgccctgaccacggcgcagttgaacgcgctgaccaccaccgacgccgcggccttgaccagcacccagatcggcagcctgaccaccggtcaactcgccaatctttcgaccgccaacctgaatgctctgtccagcaccgggctggagaccctgaaccgcacccaggtccagagtctgaccactacccaggccgccgcgctgagcaccaccgcgacaagcgccctgtccagcaccagcgtggcggcaatcagcgccaccgtgttgaacgcgctgacgaccaccagcgtcgccgccctgtccaccacccaggtatcctcgttcacggtcacccaggcggccggactgtcgaccgccaacctcaacgccctgaccaccaccaacgtggcggccctaaccacggcgcaggtgcggtcgctgaccaccgcccaggtcgccggtctgtccaccacccagatcaatgccctggaaaccaccgacctggcggtgctgaccaccgcccaggcggctgccgtcaccaccacccagctggcggccctgagttccacctccgtggcggtgctgaccacctcggccatccggtcgttgagtgcgacccagctgaacgcgctgacgaccaccgacgccgcgtcgctgaccaccacccaggtttcgtcgctgaccaccacccaggtggccgggctgtcgaccaccaacctcaacgcgctgaccacttccgccatcgcggaactgacctcggcccacgcccagagtctgaccagcacccaaaccgccgccctcagcaccactcagctgggcgccatccagtccaccgatctggcggcgatgaccaccaccgcgctgaacgcgctctccacgaccaacgtggcccagctgaccaccactcaggcgtccagcctgaccacagggcaggtctcgggcctgaccaccgcgaccctgaacgccctgaccacaaccgatgtggcggcgctgtccacggcccaggtccggagtctgacggccacccaaatcggcggcctgaccaccacccaggtgaatgcgctggaaaccactgatctggcggccttgaccacggtccagatcggcggcctgaccaccacccagtccgcggccctggcctccaccgccgtgagcgagctgacctcggccgaggtcggcgccctgtcgaccagcaacctgaacgcgctgaccaccaccaacgcggcgaccctgtccacgacccaggtgagttcgctgagctcggtcacgatcggcgggctgtcgaccaccaacctcaacaacctgagcacgaccacgctggccggcctgaccgccaaccagctgcgcggcctgaccaccacgcagaccggcgcgctgaccaccacggcggcggcggccctgaactccgcggtcatcaccatcctgaccgcgactcagatcaatgccctgtcgaccaccagtctggccgggctgaccagcacccaggtcgccagcttcaccaccacccaggtcagcggcctgaacaccaccacgctgaacgcgctggaaaccaccgatgtggcggctctgtccaccacccaggtccggagtctgaccaccgctcagatttccggcctcagcaccaccaacctgaacgccttcgagaccacggatctggctgcgctgaccactgcccaggtcgcggctctcaccaccacccagaccgccgcgctgaccagcgccggcgccggcgccctgacctccacggagatctcggccctgtccaccgcgcaaatcaacgcgctgaccaccgccaacgcggcgatcctgtccaccacccagctgtcggggatcacctcgaccaccctgggcggcctgaccaccaccacccttaacgctctggccaccgccaccatcgccggactgtcggccacccaactgtccggcctaaccacgacccaggcagccgacatctcgaccaccgcgctcggcgccatcgagaccaccgatctgcgtgccatctcggccacgacgctgaatgccctgagcaccaccaatgtggcagccctgtccaccgcccaggtggaaagcctgaccacttcccaggtggccgccctgaacaccacgaccctgaacgccctggaaaccaccgatgtggcggccctgaccaccacccaggcgcgggccttgacggccagtcaggtgtcgggcctgaacactacccaggtcaacgccttcgagaccacggacatcgcagccctgaccgcgactcaggtctccaatctgaccaccacccagaccggggccctgagcaccacggcgctgtcgggcgtcacctccacccaggtgaacgcgctgaccaccacccagatcaacgccctgtccaccaccaacgcggcgactctgaccacaacccaggcggacggcctgaccgccaatcagatcggtggcctgaccaccaccttgatcaacgccctggccaccaccaccctggccagcctgagctcgagccaggcggcgggcctgaccaccgcccaggcggccggcctgtccaccacttccgtctcccagttgaccaccaccgagttggccggcatctcggcctcggtgctgaacgccctgaccaccacgggcgtggcgaccctgtccaccacccaggtgggcgccctgaccgccacccaggtttccggcctcagcaccaccgcgctgaacgccatgaccaccaccgacatcgcggccctgaccacgacccaggcccggagtctgaccacggcccaggtgtccgagctgtccaccacccaggtgaacaacctcagcaccaccgacattggcgccctgaccaacgcccagatcggcagcctgaccacaacccaaaccggtgctctgaataccaccgccctgtcgggcatcacctcgaccggcatcaaccagctgtccaccactcagctgaacgcgctgtccacgaccaacgccgcggcgctgtccactactcaggttgatggcctgtccgcgacccagatcggtggtctgtccaccaccaacctgaacgccctgtccaccaccggtttggcctccatctcgtcgacccaggcggccggcatcacttcgacccagtcggcggccctgaccaccaccgcgctgggcgccatcgagaccaccgatctgcgcgccctgtcggccacggtactgaacgccctgtcgaccaccaacgtggcggccctgtccaccacccaggttgactccctgaccagcgcccaggtctccggcttgagcactactcagctgaatgcgctggagaccactgatgtggctgccctgagcaccactcaggtgcgttcgctgaccaccacccaggtcgccgcgctggacaccacccaggtcaacgcgctgaccaccgccgatgtcggggccctgaccaccacccaggtgagcagcctgaccaccacccagaccggggctctgacgaccaccacgctgtccggcatcacttcgacccaggtgaaggcgctgtccaccgcccagttgaacgcgctgtccaccaccgatgtcgcggccctggatacgacccaactgaccggtctgaccgcgacccagttcggcggtctgtccaccaccaccctcaacgccctgtccaccaccggcgtggccagcctgacctcgacccaggtggccggcatcagcaccacccaggcggcggctctgaccacgacccaggtcggcgcgatcgaaaccaccgatctgcgcgccctgaccgccacggtgctgaatgcactgtccaccactaacgtggcggcgctgtccaccacccaggttgactctctgaccaccgcccaggtctccggcttgagcaccacccagctgaatgcgctggagaccaccgacgtcgcggttctgagcacgacccaggtccggagtctgacgaccacccagatcagtgccctgaacaccactcagctcaatgcgctgccgaccaccgatatcgctgccctgaccaccacccaggtgagcagcctgaccaccacccagaccggggcgctgaataccacggccctgtcgggcatcacctccaccgaggtgaacgccctgtcgacggctcagttgaacgccctgtccaccaccaacgcggcggcgctgtcgaccacccaggtgtccggcctcaacgccaccctggttgccggtctgtcgaccaccaacctgaatgccctgtccaccgccgcggtggcgggcctgtcctcgacccaggcctccgccctcaccagcacccagaccgccgccctgagcaccactcagctcggcgccctggagaccaccgacctggcggccgtcaccaccacggcgctgaacaccctgtcgaccaccaacgtcgcagccctgagcaccacccaggtgtccagcctgaccaccactcaggtcggcggcctgtccaccacccagttgaatgctctggaaaccacggatgtggcggctctggccgtcactcaggcgcagtcgctgaccactgcgcagatctccggtttgaacaccacccaagtcaacgccatctcgaccaccgatgtcgcggcgctgaccaccacacagctgaccggcttgaccaccactcaggtcacggccttgaacaccaccaacctggcggcgctgaccacatcccaggtggcctcgctcaccgcgacccaggtggatgcgctgtcgaccaccaacatcgcggccctgtcctctgcccaggtgagcgctctgaccaccacccaggtgagttcgatcgccaccaccacgctgaacgctctcgaaaccaccgacgtggcggccctgaccaccacccaggtgcgctcgctgaccaccacccaggtggcgggcctgaacaccactcaggtcaacgcgttcgaaaccaccgacatcgccgccctgaccaccacccaggtcggcggcctgaccaccacccagatcggtgcgctgaacaccaccgcgctgtcgggcatcacctcgaccgaagtgaacgcgctgtccaccgcccaggtgaacgcgctgtccaccaccaatgcggccgccctgaccgccacccagctggacggcctgagcaccacccaggtggctggcctcagcaccaccaacctgaacgccctgtccaccaccggcgtggccagcctgtcgtcgacccaggtcgcggcgctgaccaccactcagatttccgccctgtcgaccactcagctgagtgcggtcgagaccactgatctggcggcactctccgccacccaggtggatgccctgtcgaccaccaacatcgcggctctgtccaccacccaggtgtccagcctgaccacggcgcaggttggatccctggccaccaccaccctgaacgctctcgaaaccaccgacgtggcggccctgaccaccacccaggtgcgctcgctgaccaccacccagatcgctgcgctgaacaccactcaggtcaacgcgctggagaccaccgacatcgccgccctgaccaccacccaggtcggcggcctgaccaccacccagatcggtgcgctgaacaccacctcggtgtcggcgatcacctcgaccgaggtgaacgcgctgtccaccacccagctcaacgcgctgtccaccaccaatgcggcgacgctgaccaccacccagttggacggcctgaccaccagccaggtttccggcctcagcaccaccaacctgaacgccctgtccaccaccggcgtggacagcctgaccaccacccagatcagtgccctgacctcctcccagacggttggcctgtccacgaccaccctggcggccctgaataccgccgaagtggccgcgctgaccgcgaccgccgtcaacggcctgtcgaccaccaacgtcgcggcactgtccaccgcccaggtttcgtccctgacgaccacccaggtgagcggcctgtccaccaccacgctgaacgccctggaaaccaccgacgtggcggccctgaccaccacccaggtgcgctcgctgaccaccacccagatcgccgcgctgaacaccactcaggtcaacgcgctggagaccaccgacatcgccgccctgaccaccacccaggtcggcggcctgaccaccacccagatcggtgcgctgaacaccaccgcgctgtcgggcatcacctcgaccgaggtcgccgcgctgtccaccgcccagatcaacgcgctgtccaccaccaacgcagcggccctcgccaccacccagctgtccggcctgaccaccaatcaggtgaataacctcagcaccaccaacctgaacgccctgtccaccaccggcgtggccagcctgtcgtcgacccaggtcgcggcgctgagcaccacccagatcaacgccctatccaccactcagctgggcgcggtcgagaccaccgatctggcgacgctctccgccacccaggtcaatgcgctcaccaccaccaacatcgcggcgctgtccaccaaccaggtcgggtccctgaccaccacccaagtcagcggtctgtccaccaccacgctgaatgccctggaaaccaccgacgtggcggccctgaccaccacccaggtgcgctcgctgaccaccacccagatcgccgcgctgaacaccactcaggtcaacgcgctggagaccaccgatatcgccgccctgaccaccacccaggtcggcggtctgaccaccacccagatcggtgcgctgaacaccaccgcgctgtcgggcatcacctcgaccgaggtcgccgcgctgtccaccgcccagatcaacgcgctgaccaccaccaacgcggcggccctcgccaccacccagttgtccggcctgaccaccaatcaggtgaacaacctcagcaccaccaacctgaacgccctgtccaccgccggcgtggccagcctgtcgtccacccaggttacggcgctgagcaccacccagatcgccgctttgtccaccactcagctgagtgcggtcgaaaccaccgatctggcggcactctccgccacccaggtgaacgcgctcaccaccaccaacgtggcggcgctgtccaccgaccaggtcggggccctgaccacctcccaggtcagctccctgtccaccaccacgttgaacgctcttgagaccaccgacgtggcggtgctgtcgaccacccaggtgcggagcctgacctccacccagatcagcggtctgaacaccacccagatcaatgccctgggaaccactgagctggcggcgctgaccaccactcagatcactgggctgaccaccactcagacgggtggcctcagcagcacctctgtgggtgcgctgaccaccacggaggtgggcggactgtccgccacccagatcaacggcctgaccaccaccaacacggcgctgctgaccaccacccaggtgtcggccctcagcaccacccaggtggcgggtctgtccaccaccgccctgaacgctctgtcgaccactaacgtggcaagcctcagctcgacccaggtgtcggcgctgacctccactcaggcggcgggcttggccaccacccagcagatagcaatcgagaccacagacctggcggccatctccgccacgaccctgaactcgctgtcgaccaccaatgtggccgcactgaccaccacccaggtgagcagcctgaccaccactcagctcaatggcctcggcaccaccacgctgaacgcgctggaaaccaccgatgtcgccgcgctgaccaccactcaggtgtccagtctgaccaccactcagttggtcggcctgaccaccaccacgctgaacgccctgtccaccacggacatcgcgggtatgacctccacccaggtgaccagcctgaccaccactcaggtcgccggcctcagcacgacggcactcggcgccatcgagaccaccgacctggatgccctctcgaccgcccagttgaacgccctgagcaccaccaatgtggctgcgctgtccaccacccaggtgtccagcctgaccaccacccaggtgtccggcctcagcaccacgcagctgaatgccctggaaaccactgatgtggcggccctcacggtcactcaggcgcagagcctgaccgcgacccagatcagcgggctgagcaccacccaggtgaatgcgttctccaccacggatctcgcgtcgctgaccacctcccagatcggcggcctgacctccacccaggtggcggccatcagcaccgccaatctggcggtcctgacctccaccgaaatttcggcgctgtcgaccaccaacctcaacgcgctgatcaccgcccaggtggcgagcatcaccaccacccaggtggctggcctgaccgcgacccagatcggcggactgaccaccactcagctcaaccagatctcgaccacgaacatcgcggctctcaccaccacccaggtaagcggcatcagtgccgcccaggccacggccctgagcaccgcgaccctcgggacactgaccgccactgagatcggtgggctgacctccacggcggtgaacgcgctgaccaccaccagcatcgccgccctgaccaccacccagatcagcggattggtgaccagccagctcgctaacctgaccaccaccgcgctggcagccatcgagagcaccgatatcggggcgctttccaccacccagttcgaggcgctgacctcgacctccatcgcggcgctgatcacgacccagatcacgggtctgagcacgacgcaattggcggccatgaccaccacccaactcagcggtctggagaccaccgacatcctggccatgacctcggcccaggccacggccctcggcccgctgaacggcagcatgaccaccgcgcagaacagcgcctggtccaccgcgatgagctatccgtgatcccggatatgagccgtccctgaagggacggctcatggtgggcgttctttcgcgtccccacgccgtcaacggcgcgggagcggctttgccgcgtggcgcgacggagcattccggcctgcacgtcgcaagcatcaatccgttaactattgaccggtcattatgagcggcgccccgcttggaatgacgtttcgagcgggtcccggcacaaccggaaacggaacgctcgatgacccaggatgtctttctgtctgcggtgaaggcccttaccgaagggcggctgacgcttcaagacgtgttcggcacagccgagacacttcaccggggcggcaacacggatttggccctgcagctttatcagctgtggatcgggctcaatcgcgaccatcaccttctctatgccgcctatttcaatcaggcggtgaccctttcggcggcgggacggcccgaacaggcaagggtctcgcttgaaaagtccatcgaactgaatcccgatttctacccggcctacatcaacctgggcggtgtgatggaagcgctgggccagccggatgcggccgtggacacctggaatggactggtgacccggctgggcgccatcaccggccacggcatccgcatgaaatgcaccgccttgaagcagatcgcccgcgtcctggaagaccgccaccagatcgtcgcggcggagaacgtgctgcgccaaagtctggaattggacaacacccagcgcgagaatgccgagcacctgctggcatcgcgcatggtccagtgccactggccggtgatcgagccgttcgagggcatggacgcgccgttgcagatgcgcaatttcagtcccctgtcactggcggcctataccgatgacccactgctgcacctggcctccgcctgggagcattgctgcaagatgttcggccggcgcattccccgcctgcccgacgtcacaccggcggatcgggccgaccggacgcggctgcgcatcggctatgtgtcttcggacctgaaggcgcatgcggtcggctacctgatcgccgaagtgttcggtctgcacgaccgcgccaaggtggagatcttcgcctattattgcggcccggccggcgaagaccccttgaagcagcgcatccgcgccgatttcgatcactggatcgacatcaccggcatgaatgacgagacggcggcaaaccgcattcgcgacgacggcatcgacatcctggtagatctcaacggccatacgaaggcggcgcggacccgagtcttcggcatgcgtcctgccccgatcaacgtcaactggctgggctatcccggcaccatgggcaccgcctaccatcactacatcatcgccgacgaatggatcattccgccggggcgcgagatgtactgttcggaaaaggtagtgcgcctgccctgctatcaggcgaacgaccgtcggcgcgccgtggcctccgagccgccatcgcgggccgaggtgggcctgcccgaggacaagatggtgttctgctgcttcaacagccagcagaagatctcgccgttgatgttcgatcgctggatgcacatcctccattccgttccggaaagcgtgctgtggctgctggaatgcggcgaggagatcaagaaccgcctgtgggagcacgcagagcgcggcggcatcgcgcgcgagcgggtgatcttcggcaagcgcctgcccagccccgatcatctggcccgcatgaccctggccgacctgttcctcgataccttcccctatggcgcccacaccaccgcctcggacgccttgtggatgagcgttcccatcctgaccctgtcggggcacagcttcgcctcgcgggtgggtggatcgctgtcccgttcggcgggtctgcccgaactggtctgctcgacgccggaagaatacgtggagatggccatcgcgctgggcaacgaccgccccagactcctggcctaccgcgagcagttgcgcgccgccaagcccaacgcggtgatgttcgacaccaacctgctggtcagccggctggaggatctctacgccgagatgtgggccgatttccaggctggccgcctgccgcgtcccgacctggccaatctcgacgtctatctcgacgtgggcatcgagcacccggccgacacctcggatttcaccgccgaggacgagtacttcgcccgctggcgcctcggcctggccgggcgcaatcacctttatcccctttcgccggacagccggctgtggaccaaccccgacacggagaacggttgatgagcgatgccctcgcggaggtcctgaatcagatcgcgtccggcaagatcgaagcgacccgcgtcatcgcggcggccgacagcctcgccctgcaaggggccgatgccgatgcgctgggcctgtaccgcacttggctgcaatacaacagcgccaatccgctggcctatgccatccagtacaatatgggcgtattgctgggcaagttcggggaccatgacggcgccgtcaccgcgttcaaggccgccatcgcccagcgggccgacttctatccggcccacatcaatttgggcagcacctacgagcggctgggacgcacctcggacgcggtgacccagtggctgggcatggtcaaccaattgcccgccatcaccggtgaatcggtgaactacaaggtctcggccttgaagcagatcggccgtgtgctcgagcacacctcgctggaggaatcgggcgaggacgccctgcgccagtgcatcgagctggtccagcctgccgacgccatgcagcactggatcgccatccgccagaagcagtgcaaatggccggtgctgagcggcatcaccggccccacccggcgccagctcttcgccgccatgtcgccccattgcctggtgttccacaccgacgatccgttgctgcacctggcccggggctacaagtactacaaggccaagatcggccgccccaaggtgttcttcgaccgcgacagccatcgcgccgccctggcgacccgccccaagcggcgcatccgcatcggctatctgtcgtcctatttccgcgagcacgcccacggctacctcaccgcggaaatgtacaagctccacgaccgctcgcgcttcgaggtcttcgcctattcctgctcgcgccgcaccggcgaccgcatccagacccaggtgatgaaggacgtggatcactgggtggatatcctggagatgtccgacgaggatgtggccaagcgcatcgctgccgacggcatcgacatcctgatcgacttcaacggctataccggcgaggcccgcccggccatcatggccatgcgccccgcccccatcgccgtcaactggctgggctatcccggttccatgggcacgccctaccacgactacgtcatcgccgacgacttcaccatcccgccggacttcgagatgtattactcggagaaggtggtgcggctgccctgctatcagcccaatgaccgccagcgtcaggtggccagcatcaactggacgcgcgaagccgccggcctgccggccaacgccacggtgttctgcggcttcaacggcgtgcagaagatcaccgcccccatgtgggagcgcttcatggacatcctcagccgggtgcccaacggcgtgctgtggctattggacggcggcgaacgcatcaacgagcgtctgcgccaggaggccatccgccatggcgtcacccccgaccgcatcatcttcgcgcccaagctgatcaatgccgagcacctgtcgcgctatcccctggccgacctgttcctcgacacctcgccctgcggcgcccacaccaccgcctcggacgcgctgtggatgggggttcccgtcctgaccgtggccggacgcggattcgcctcgcgggtctgcggcagcctggccgtggccgccgggctgggcgacatggtctgcaccaccttcgccgaatacgtggaaaaggcagtggagctgggcaacgacaagcgtgcccgtcaggccatccgcgatcgcttggccgccaaccgcgccacctgcgacctgttcgatacggacaagctggtctcgcacctggacggtctgctggccgccatgtgggaggacttcgtcgccgaccgggttccgcgccccaacctcgccaatctcgacatctatgacgagatcggcaccgatctggaccgcgacgacctggaactgatcgcccgcgccgattatcaggacctctaccgcgcccaattgcgcgaggtcgatcgccactgccccgtcgcacccgatgcccgcctgtggccgggcgagccggccccgccggcgcaagcggcaaaggcagccgcccccgccaaggggaaagcaaaaaaggcaaagtagacatccagccggacgttgaaatccccatccgatttttgtcgggtggggattttgctttcagcacagacaaatggaatacccggaatcacattggtacccattggtatgtatcttggtcagctaactttcgggagacaccgacactgccatcccataaaataatcatgacttttgcattagagcttacgaataataaccgtcccgtcattttgccccgcatcggcgacgccagcccgggaccaaggagagccgccatgttcgccaatctgaagatcgggacgcggctgtttgccgggttcgccctggtgctgtcgctgaccgccttcctgggggtcaatgccgacatcgccggcgacgcgctgtcggagcagaccaacaagctgtatcgccaccccttcacggtgaccaatgcgctgcaggcggccaacactcatatcgtcgccatgcaccggtccatgaaggacgtggccctggccaaaacgccggaggaactggaccgcgccgtggccgacgtggatgcgcgggaaaagaaggtctacgagaagttcgccctggcccgcgaacgattcctgggcgacaaggcggacatggaggccgccgccaaggccttcgccgattggaagcccattcgcgacgaggtgatcaccgccttccgcgagggacgccgggacgacgccgccaccatcaccaagaccaagggggcggcgcaggtcgccaagatcagcgaaaccctggagaaggtcatcgcctgggccatggacaaggccgaggccttcatggccaatgccgaacaggtcaacgatcgcgccgatctgatctcccgctccggcctggcggcggcgctgatcctcggcgccctggtcgcctggctcatcacccgcagcatcagccgaccgatcaacgccatgaccggcgtgatgaacgagctttccggcaacaatctgagcgtcgacgttccttacgccgatcgcggcgacgagatcggcgccatggccaagtccgtgggccacttcaagaaccagctgatgcgggtgcaccagttggaggccgagcaggaagagcagaaaaagcgcgccgaggccgaccggatgacggccatgcgcaagatggccgacaccttcgaggaaagcgtcggcaaggtgatcgagacggtgacctcagccgccaccgagttgcaggctgcgtcgagccagatgtcgggaaccgccaccgaaaccagcgcccaggcgaccacggtagccacctcggcccatcaggcctcggccaatgtccaaactgtcgcctcggccaccgaggaactggccgcctccatccgggagatcgcccatcaggtggagcggtcccaggcggtgtccgcccatgccggccaggaggtgaacaccaccaccagccaagtccgcgccctgtcggaaagcgtcagcaagatcggcgagatcgtcaatctgatcaatgacatcgccgcccagaccaacctgctggcgctcaacgccaccatcgaggccgcccgggcgggcgatgctggcaagggcttcgccgtggtcgccaacgaggtcaagcacctcgccaaccagacggcgcgggccaccagcgaaatcgccggccagattcaggccgtccaggacggaaccaacgccgcagtccacgccatcgacgccatttcctcggtcatcggcgaaatgggcgagatcagctccgccgtcgccgccgccgtcgaacagcagagcggcgccaccaccgagatcgcccgcaatgtggagcaggcggccaccggtaccgaggaggtgtccagtaacatcacctcggtggaacaggcggctcgcgaaactggcgcggcggccgagcagatcaaggattcctccgccgatctgtcgcgtcaggcggaattcctccgtcacgaggtcggccagttcctcgcccaggtgcgggccgacaagaaggacatgaagcttctggtctgggacggcgccctgaataccggcgtggcctcggtcgaccggcatcaccaggccatgtacgaccaggtcaacgagttctaccgccagatgatgagcggcgacggcagccgcgccgccgccgccatgctggccgaactgaaccgcagcatccaggatcacttcaccgaggaagaggccctgatggacaagacccgctatccggcggccgaggaccatcgccgcaatcaccaggccttcctggaccgcctcgccggcatgaagaccggcctggagaccaaccgcgccgaggcgccggccgagatgttcgaatacgtctccacctggctgcgcggacatatcggcaatgacgaccgggcgctggggctgcacctgcgcgagacgcgggccgtcgcctgatcctttgtgccatggcccatcacgacgaagtcccggcaggtcgccccgccgggactttttcgtcgatcccccccggatgatctcaggcggtgaggtccagcagcgagccgcgccgggtcgagggctcgaccttggcatcctccgaccgggtcttggccgggcgttcgtcgctttccgttttctccgaactgtcggcggccgacgcgggcgccagctgggtgacgcgcgaatagctgcgggcaccgtagaccgaaggccaggagacggattgacggatcaggtcggacatggcgaaacccgcggataacaggccccaagcctaccacaagtcaagaggttaacaaaaggtaaaagacgattgagcttgacccgaccgctccgatggcgcagccttttgcccctgggaaatcagggagtccccttgtcccagcgcgacgccgccgcgtcgtcggattgcttggcctcgacccaggcatcaccctccggggtatgttccaccttccagaacggcgccttggtcttcagccagtccatgaggaaacggcaggcctcgaaggcggcatcgcggtgggccgacgacgccgccaccagcacgatgcgctcgcccggctccagccggccgaagcgatgaatgaccagggtatcatccaggggccagcgctggcgggcctcggcttcgatggcctccaactggcgctcggtcatgccgggataatgttccagggtcatggcgttgacggcggcgccgctggccggatcatggccggcataatcgcgcaccagcccgacgaacaggcagatgccgcccacgctggtcttgcccgatgaaaaacgctccagctcggcgccgggatcgaaatcctcgcgctgcacccgaacggccatgtcagcctcctgtgacgggcgggaagaacgccacctcgtcgccggccttcaccggagtgtccaggttgccgtaatcctggttcacggcgacgcggaccgtgctcatcacctcgaaggcggcggcgtggccgggcgagcgggtcttgaggaacgccaccaattgcccgacggtggccacctcggcgggcggggcgacgtcctcctcccccactccggtcttggccttcagccaggcgaagtacagcaccttcatcgcatcatgtccgcataggagaggaagtccaccatctcgccgggcgcgatgtcgccccggtcctcggggatgtccaccagcccgtccgaccaggtcatggaggtcagcacgcccgagccgtcggaggggaacttggccgccaccagccggccgtccatgtgggcgaggcgggcgcgcagatattcgcggcgccccggcttgtgcttgaaggcgaagccggcctccaccgggtagcggggcaaggcggtctgggcggcccccatcaggcgcagcaccatgggccgggcgatcagcatgaaggtgaccatcaccgccaccggattgcccggcaggccgacgaagggcgttcccgccacctcccccagggccacggggcggccgggcttgatggccagacgccagaaatccagcgaaccctgggccagcacggcgggcttcacatggtcctcgtcgcccaccgacaccccgcccgaggtcaggatcagctggtgcgacacagccgcttcggccagggcatcccggatggtctcgaagcggtcgggaaggatgccgagatcggtgacctcggcccccagggcgcgcagcaggcccgtggcggtaaagcggttggtgtcgtagatgcagccgggcggcaggtcggcgccgggatcgcggatttcgtcgccggtagagaacacggcggcccgcagcggccggtaaaccttgagggacgaccggccggtggccgccgccacgcccagttcctgcggccgcagccgggtgccggcgcgcagcaccaccgagcccttcgagatgtcctcgccggcctgccgggcattgtcgccctccgccagcctgacgggcagcgccacccggccgtccaggtccttacagtcctcctgcatggccaccgtgtcggccccgtccggcatgggcgcgccggtaaagatgcgcaccgcgccgcccgcaggcagcggcccgtccaggggatggccggcggcgacgcgccccaccaccggcaggatgccgtcggcgggcaggtcggcgcggcgaaaggcccagccatccaccgccgaattgtcgtggggcggcacattgaccgccgagaccacgtcgtcggccaggatgcggcccaggccgtcgtgcagacggatatcctcgacaccgacggcgggggcaaggcgctcttccagccgggccagggcctcggcaaccgtcatcatgtccgcggagacggcgaaacggtcgctcacagcccaaccctttctacgaccagcccaaccctttcggcgatcagacggccgatggcctcggtatcgtcgacgttgagctggggcagcgggcaggccggcgcgggataatcgctgaccaaagccagcatgcggtcgtcctcgggccagagggggggcttgcccacctcgtcgcgccagacttccaggcggggatggggccactggcgaaagccttccaccagcaccagatccaccgcgctcatgcgggccagcaactgatccatggaatattccggctcatcgcgatactcgtgcatcagggcccagcgccgcgccgaggcgatcatcacctcggaagccccggcctcgcgatgctcgtaggaatccttgcccttcttgtccacgtcgaaggcctcgtgcgcctgcttgacggtggagatggtgatgccttgggcgcgaaaccagggaatcaggcggatgatcagcgaggtcttgcccatgccggagcgcccggcgatgccgaacaccttcattccgccgattcccccatatggctcatgcccgagcgcaggtagtcccagccggtaatgatggtcaggatggcggcagcccataggccgacctcgcccaccagccgggtgggcatgaaggtggcggcgtcgcccaccagcagcaccggaatggcggtcatctgaatggcggtcttccacttggccagccgggacaccggcatgcccacccgcacctcggccaggaattcgcgcaggcccgagaccaggatctcgcgcagcacgatgaccagggcaggcaggaaggacaccgtgctgagccggtcgaaggcggccagcatgaacagcaccgaagccaccagcagcttgtcggcgatggggtcgaggaagcgcccgaacttggacacctggttccacgaccgcgccagatagccgtcgaaccagtcggtgacggcggcggccacgaacagggcgcaggcggcccagcgggcggcgtcgccgtccacgtagaacaggccgaccaccaacggaatcacgacgatccgcgacagtgtcagcaggttgggaaggctggtcagcataacgccgggatactaaccctcgggatggaagtagtcatgaatctttttggccatggcgtggctgattccctcgacgctttccagatcgggcagaccggcctcggccacggcgcgggccgagccgaaatggtgcagcagggccttcttgcgctttggcccgatcccgggcagagcgtccagggtggattgaaccaatcccttggaccgccgggcccggtgggtgccgatggcgaagcggtgggcctcgtccctgagacgctgcaggaagtacagcaccgggtggcgggattccaggctgatgggctccttgcccgccaggaaaaagcgctcgcgcccggcattgcggtcggggcccttggcgatgcccaccagcatgacgtcgtcgatgcccagttcggccagcacgcccagggcggcgttgagctgcccccgtccgccgtcgatcagcgccaggtcgggccacagcccccggtcgcggtcgggatcctccttctgggcgcgggcgaagcgccgggtcagaacctcgcgcatcatgccgaaatcgtcgccgggggtgagatcggtcgagcggatgttgaacttccggtaagccgatttcatcagcccgtcgggaccggcgacgatcatcgcccccaccgcgtccgagccctggatgtgggagttgtcgtagacctcgatgcgctcgggcgccgactccatcccgaacagttcggccaccccttccagcaatttgcgctgcgccccgctttccgccatgcggcggcccagcgcgtcgcgggcattgtcgtgcgcatgctccaccagccgcttgcggtcgccgcgcttagggacggacagggtcaccttgcgcccggccttttccgacagggcctgggcgacgatggcgacctcgtcgggctccagcgacagcaggatctcgcgcggcggcgtcttgtcggcatagaactgccccaggaaggccgccatgatctgcggcgcctcctcgccctgagcgtggaccgggaaataggcgcggttgccgtaattgcagcccgagcggaaaaaaaacacctggatgcacaccccgtcgccggcctgatgcagggcgaccacgtcggcctcctccacctcggcagggttgatgtcctgatgggcctggatacgggtcagcgcccggatacggtcgcggaacaccgccgccgcctcgtattccatggcctcggccgcgctttccatgcgggcggtgaggtcgtgctggacgcggcggctctggcccgagagaaaggccctcgcctcctccaccagcgccagatactcgtcgcggtcgatgcgctcgacgcaaggcgccgagcagcgcttgatctggaacagcaggcagggccgggtccgcgaggcgaacaccgaatccgagcatgagcgcagcaggaaggcccgctgcagcgccgccagggtctggttcaccgcccctgccgaggcgaaggggccgaaatactcgcccttgcggttgcgggcgccgcgatgtttcagcacctgcggccagtcatggtcggcggtgatcaggatgtgggggaaggtcttgtcatccttgaggaggatgttgtaacgcggccccaggctcttgatcaggttgctttccagcagcagcgcctcgacctcggtgcgggtggtcaccacctccatggaggcggtctcggcgatcatgcgctggatgcgcagcggcatgcggtcgggcctggtataggccaccacccgcttcttcaggctcttggccttgcccacatagagcacgtcgcccttgccgctcagcatgcggtagacgccggggctgagcggcagggtcgccaccacttgggcgataacctccaccccccgggccagcggcgtggcggaactgtccgcttcggtcaaggcgcgcctcccgcgatgtcagggcaccggtttaccctatctacttcgcaggggcagcagaatttcccttgcatcccgggatatccacgaaagctgtggataagtctgttggcaagttcacggagcaagggcagtccccttgagtctcctggggtccgagcactttgcccattttgtgagcacggtcgctgtctcgttatttttcaatgagttagtcaagtcaagtgtaaacaattggcaaatatctgctttttcccctggacagaatggcggcttcctgccagatgctgcgccgcaaaaaagcctgtgaacaacttaacacttccaccccttggggcagagtcccaggcgcagcctggaccgttgcggaagcggttcaaaagttcagactgccgcagtgcaacagatagggccaatcactcatcaggggtagtaccacccaccgcccagcccaggtgctgccccccatccaatgcgatcatttgaccggtgatggagggggttgccaacaagaagcgcagggtccggcacacctcttcaggcgaggtgccccgggccaggggcaggtccgccacctgggcggcgaactgggcctcggtctggcgcgaactgggcagggcagggccgggaccgatgcccaccacccggatgcggggcgccagggccagggccagggtctgggtggcggcccacagggcggccttggacagggtatagctggtgaaatggggcgtcaggctccacacccgctgatccagcagattgaccaccaatccctcggcatccgggggcaaggcgcgggcgaagccttgtgtcagcacgaagggggcgcgcaggttgacctccatgtgcaggtcccaactggcgcgatcagcccccagggcgtcgtccttctcgaacaccgaagcgttattgaccagcaggcccaggggccccagcgccgattgggccgatgcgaccagggaggtcacctgatcctcgcggcccaggtccgccgacaccaccacggcgcggccgccatgaccggtgatctcgtcgcggaccgcctgggcgtccgccgccgaatgatggcaatgaaccgccacggcaaagccctgccgggccagatcgagggcgatggcgcgaccgatccgccgcccgccgccggtgaccagcgcggcccggggcagaaggggcgatacgccgtcccgggtcatcgggacttggcagccacgggctgggcggcgggggcctccgccccggatgtctccgccgcgggagtctggggacggggcttgctggccaccacctggacggtcggcttggcggcggcggggcgcgacggggccggcacacggtccagggcgcccagcacgtcgccggcatggggcggacgccgggacgggtcgggatcggtacaggcggcgaccagggccgccaattgctcgggaaagccgccgggcagcaccgccggcaccgacaggtcgggcaggccgccgatcagcaggcgataggccagcacgcccagggaatagacgtcggcccgggaatccacggcggtggcgttctccatctgctccggcgcggtgtaggcggcgtcgcccatccagaagccgggcaggggcaggttcttctccgccagcttgatcagcgagaaatcgcacagcttcacggcgccgttctgggtggccgacagcagcacgttggacggcttgaggaagcggtggaccagcccccgcttgtgcagcgccaggacggccgaggacaattgcttcatcaccagcatggcccggctgccgttcatgcggcgcggccggtcgcgctcggacgcggcggcggcggcctcggcggtgggaaagtccttgccgatctcatagggaagatgggccgccatgtagggcatgacgaaatagggccgcccgtcggccagatgctccagcgtcttgaccccgacgatataggggtggtcgaaggacgccagggtgcgcacctcggtgaggaagcggctcagctgctgcgcgggactgagcaggctgtcgtcgcccggcttggggtcgaacagcttggccgccaccggaacctgcaggtccggatcgtggcacagaaacacccggctgtagcccgtggtgaccaccgccgtgtgaatgacgtatttgcctatgcgctccatgagctttcccatgctccttcccggccggcgcgagccccggccccatccttgggcattactctaacagagtagaaagcgctcgtccccatgaccgatgggtagttaccgaatcaaccgcgccgacgccccctgggcttgccggtggagcgcggccgccccttggtccccagattgacctcgatgcccaggtccagcgcctccaggcggcgcaattcgtcgcgcagccttgccgcctcctcgaactccagatcggcggcggcggccttcatgcgcttttcgatatcggccttgaccgaggccagattgtgcccgaccccgtgggccagcccggaatcgccggtgcccaccgtgacgtaatcggcctcgtagacgctgtccatgacgtcggagaccgccttgcggatgccttccggggtgatgccgtgaagggcgttgtaggcctgctgcttctcgcgccgccggttggtctcggccagggcgtagtccagggaggcggtcatcttgtcggcgtacaggatgacccgtccgtcgatattgcgcgcggcgcggccgatggtctggatcagcgaggtcttggagcgcaggaatccttccttgtcggcgtcgaggatggccaccagggcgcattcgggaatatccaggccttcgcgcagcaggttgatgccgatcagcacgtcgaaggcgccgaggcgcaggtcgcggatgatctcgatgcgctccagggtgtcgatgtcggaatgcaggtagcgcacccgcacgccgttgtcgtgcatgtactcggtcaggtcctcggccatgcgcttggtcagcgtggtgaccagggtgcggttacccagccgcgccatctgccgcacctcgcccagcaggtcgtccacctgatgctccacgggccggacgatgcagaccgggtcgatcaggccggtggggcggatcacctgttcggtgaacacgccgccggtgcgctccatctcccacgggccgggggtggccgagacatagaccgtctggggccgcatcagctcccattcctcgaacttcagcggccggttgtcgatgcacgacggcaggcggaagccgaactcggccagcacgctcttgcggttgaagtcgccgcggtacatgccgccgatctgcggcacggtgacatggctttcatcgacgatcagcagggcatcttcgggcaggtactcgaacagggtgggcggcgggtcgccggggcgccggccggtgagatagcgggaatagttctcgatggacttgcagtgaccggtggtctccagcatttccagatcgaaattggtgcgctgttccaggcgctgggcctccagcagcttgccctcggcgtggaagcgctccagcgtctccttcagctccgccttgatgcccttgatggcctgggtgatggtggggcgcggcgtgacgtagtggctggacgggtagacggtcacctcggacagcgaacaggtcttctcgccggtcagcgggtcgaactcgttgatggcctcgatctcgtcgccgaacagcgacaggcgccaggcgcggtcctcgtagtggacgggaaagatctccaccgcgtcgcccctgacgcggaaggtgccgcgctcgaaggcggcgtcgttcctggtgtattgcagttccaccagacgcttcaggaggtccgagcggtcgatgctttcgcccaccttcaaggcgacggtcatgcgggcataggattccaccgagccgatgccgtagatgcacgacaccgaggccaccaggatcacgtcgcgccgttcgagcaaggcccgcgtcgccgcatggcgcatgcggtcgatctgctcgttcaccgccgaatccttctcgatataggtatcggtgcgcgggatataggcttcgggctggtagtagtcgtagtaggagacgaaatactccaccgcgttatcggggaagaagcccttcatctcggcgtaaagctgggcggccagggtcttgttgggggccaggaccagggccggacgcctggtcctggcgatgacatgggccatggtgaaggtcttgcccgagccggtgacgcccagcagcacctggtcgcgctcgtccgcgtccaccccggccgacagttcggcgatggcctggggctggtcgccggccggctgatagtcggagacgatcttgaactccacatccccctcgggcaggggcgggcgttccatgaagtcgaagggcagtggacggctcatggcggcagtatagagcctccacgagccgaacggagccccttttgcggctcagctcgcccgaacttcggcgatgaagccgcccacattgccgcgcagccggtccgattcccccgacaggccgtcggccagccccgacaattgctgggcggcgacgccggtctggcgggcggcgtcgagcaccttgccgatggattgggagacctcgctggtgccggcggcggcctgctggacgttgcgggcgatctcctgggtggcggcgccctgctcctccaccgccgaggcgatgcccatggtgtaatcgttgacggtggcgatggtggtggcgatgccgccgatggccgccaccgcccgctcggtctccgcctggatggcgcccacctgggcctggatgtcgtcggtggcccgcgccgtctggttggccagattcttgacctcgcccgccaccacggcgaagcccttgcccgcatcgccggcccgcgccgcctcgatggtggcgttgagcgccagcagattggtctgactggcgatgtcggtgatcatgttgaccacgtcgccgatgcgccttgccgcctcggccaggccgcgaacggtggcgttggtggcctcggcctcgcgcaccgcgccgtcggtggcggtggcggtttccgccacccggcgggagatctcctggatgctgtgggacagttcctcggcggcggcggccaccgtctggacattggtgctggcctcctcggcggcgctggccaccacggtggattgctcggtggtggtggtggcggtctgcgacagggtctccgtcgaggcccgcaggccgttgacggccgtggccacgcccccgaccacggaatcgatggaatccacgaaagtcgtggtgacggcttccacccgctggcgatgctggtcgcgcaggcgcgccgcctcttcctcccgcgcggcgcggctgtccgcctcgcgggcattgtcgcgcaggacctggatggcggtggccatggccccgatctcgtcggtgcgcccggcatggggaacggaaaaatcgcgcgagccgccggcgaagtcgccgatcacccgggtcagttcggccagcggcgccaccacgcggcggccgatgcccaccaccacgaaggccagcacgcccgccgccgccagcatcaggccgcccatgagcaggagattgcgcagggcattgtcgcgcttttcgtcggcgacccggcgggcctcgccgatggcggcgtcgcgcatgagcatgatggcctgaagcatgggcgcgctctggcgccgccactcggcggggtcgaggtcgtacttgccgtcggccataccggccttggtcacccgggcgcgcagcggctggaacggccccatgtaggccgaattgaccttggccaacccgtcgcgcagaccggcggaactgtcgggagaaccggcggccgagttcaggatgtcccacaattgctgaacccgcccatcggccaggtcgatctggtggatctgctcggcggtgaagggcttgccgccctggattaccgacagatgcatggtggcgaggcgcccgccatggtcgcgcaattgccaggcggtctcggccagggaagccggcgtcgccacctgggcgtcgatggcgaacaggcgccgctccagccgtccggtcatgccgccggccaccttcagcacgtcatacatgccggcgacgaagtccttgcggaagggggcgatcttctgggggtcggaaccgatcacgccatcgctccggctccgccagtcggtgatggcggtacggatcttcgccaccccctcggccacgtcccgggcctcggccagcggcgtggccagggccagcttctcggtggcgttcagggcttcgtccagggtggcgcgcacctcggccatggtcttgcgggcggcggggtctccgtccagggcgacgctggtggcgccccgttcgggggccagggcctcggaaatccgggtcgatacgccgagcagatcgaccagttggccggcatcgcgcgcggcgcggtactcgccccaattactggccaacagcacgacggccgtgagagccagaacagcggcaaccgccgccagacaggccgaaacgaagcccttgatcgacatcgccacctcccttgggtcttggccagaccacaccctttgtccaaggctaacatagacggagggtcttacaccatatgggggaggatacggatgacggccactcaggacgcgggagaccacccacatcggcgcaacgcctcgaccatgtgctcgggcggcggcgccgtgacccgcaccgggtccttggacggcgccagggcgggaaaggccaccgcgcgggccagcaggtgcagcctgaccttgggctccgggtcggggccgtaataggcgtcgcccagcagcgggcaaccgagatactgggcatggatgcggatctggtgggtgcgcccggtgcgcggccgccattcgatccaggagaggccatcgctccgccccaataccgaccagtcggtaatagaaggctgccccgccgggtccaccttgatccgccagccctgcccccgggccgagaccttgagcagcggcgcgtccacggtgccgctgtcggcggcgggtgatccatgactgaccgaccagtatactttctccacccgccggtgctcgaacatcttgcccagacgcttgatggccttggcatgacgcccgaggatcaggcagcccgaggtatcgcggtccaggcgatgggccagcttgggcatttcggcccaaccgaaggccagcgcccccaggtaaagctccaggtggtcgggcgaattgggaccggcatgcaccgccagcccggcgggcttgtccaggacgatgacgtcctggtccttgtagagcacgcgggaaaggatctcgtcgggggtcatgaaaaaaggctctcgggtgtcatcccgacaaccatcgggaggagggatctcgtcctggcatgatcgttcagaccttgagccagcatgccagacggagattcctcgctgccgctcggaatgacaatggaaatccggcttaagccgatcttaacggcggcgccctaccctttcgcccatccgcaaggagagacgcccaggaaatgaagatcatcgccaccatcgaggcgcgcatgacctcgtcgcgcctgccgggcaaggtgctgctgccggcccagggcaggcccatgctggcccgcatggtcgagcgcctgaagatggtgccctcgctggacggcatcgtggtcgccaccaccgtcaacgccaccgacgaccccatcgaggccctggcggccgaactgggcatcggctgctggcgcgggtccgaggacgacgtcttgaagcgggtgctggacgccgcccacgccttcgaggccgatgtcatcgtcgagctgaccggtgattgccccctgatcgaccccgccatcgtcgaaacctgcgtccaggcctaccgggccgccggggtggactatctgtccaacgtgcaagagcgcagcttccccatcggcatggatacccaggtgttcgccaccgccatcctggacgacgtggcgcgccgcaccgacgatcccaccgatcacgagcatgtcagtctctatatctaccgccacccggagctttactccctgaagaacgtggcggccccccccgaactgcgcgacccggagctgcggctgaccctggacaccccccaggattaccagctgatcgatcaggtcttcgcggcgctgctgccccagggtcccggctttgccctcggcgacattctggcccttctccaggcgcggcccgagctgcgcaagatcaacgaccatgtcgcccaccgctgggtctgagccgctgcgggcgctgatcatcggctgcggcgccatcgccggcggctatgacgaggccgagcccaagtcggaccagatcctgacccacgccaaggcctatgcccgccatcccggcttcaaggccgtcgcctgcgtcgaacccgacgctgagcggcgcgctgccttcatgacggcctgggacatccccgccggcttcgccactttggccgaggtggacctcgcctatgacgtggccagcgtctgcgtccccaccgcccatcacgccgagaccctggaggcgctgctggcctcccccgcccggctggtcttcgcggaaaagccgctgaccgacgaccttggccgctcgcgcgccatcgtcgaggcctatgagcgggcgggcaagccgctctgcgtcaattatctccgccgctgggccggcggcctcgtccatctgcaggccgagatcgcccggggccagtggggcgccttccagaaggcctcggcgtggtacaccaagggcctgctgaacaacggcagccatttcctcgatctgctgtccttcctgctgggcgagctggcgccggtctgcgcgctgggcaccgtggccgacggccgcgccgacgaccccacccgcgacgtggtggtgaagaccgctgcgggcgcccccattcatctgctgggggccgacatgcacgccttctcggtgttcgaggccgagctgatgtttgccggcggccggatcagcctgaccgattccgccttcaagatcacgcggcgcccggtgaccgacagcccgcgcttcgccggctaccgcaccctggccgagggcgtcaccaaggacagcggcctgggctatgccatgctcgacgccgtcgacaacatcgcccgccacctcaacgacggcgcccccttgcgcagcaccgggcacagcgccctggcggtccaggagctgtgcgccaccctcgcctgtctgccggagacccattgatgagcaccctggcccttctgggcggcgatcccgtccgcaccaagctgttccccgcctattcggtcatcggcgaagacgaccgcgccgccgtggccaaggtgatggaaagcggcatcctgtcgcgctttctcggcacctggcacaacgacttcttcggcgggccggaggtcaaggccttcgagcacgaatgggccaccgccttcaaggcggcccacgccatcagcgtcaattccgccaccagcggcctttacgccgcggcgggcgccgccggaatcgggccgggcgacgaggtcatcgtctcgccctataccatgagcgcctcggcggtggccgccctggtgttcaacgccgtgccggtcttcgccgacatcgatccgcacagctattgcctgtcggccaagaccatcgccgcgaaaatcacgccgcgcaccaaggccatcatcgtggtgcacatcttcggcaacgtggccgacatggaccccatcatgaccctggccaagacgcacggcctgacggtgatcgaggattgcgcccaggcgccgttcgccacctacaagggccgcccggtgggcaccctgggccatatgggggtgttcagcctgaactatcacaagcacatccacaccggcgaaggcggggtggtcaccaccaacgattcccgtctggccgagaaggtgcagctgatccgcaaccacgccgaggcggtggtggagaagaagggcacggccgatctggtcaatatgatcggcttcaacttccgcctgggcgaaatcgaggcggccatcgggcggcggcaattgctgaaaggccccgatctggtgcggcggcgccaggccaatgtccgatacctggaggaccgcatcaagggcatccccttcctgtccatgccccaggtccaggacggagtcgagcacgtctactacgtccacggcctgtcctatgattccgaggcggcgggcgtgtcgcgcgccaccttcgtgcgcgccctgaaggccgaactggccgccaccgaattgcgggaaggcgaaggcgtgctgatgggcgaaggctatgtccgcccgctctacctccagccgctctaccaaaagctggtggggtatggcgaggtgggctgtcccttcaaatgcccccattacaccggcacccccgattacgccccgggctcgtgccccgacaccgaggatgcccatttcaaccgggtgatcacccacgagctgatccgccccccggccagccgcgccgatctggacgacgtggccaacgccttctccaaggtggccgagaacatggcggcgctgcgcgacatggagcgccagtgatgtccaaataccgggtcgagccccttgcggccctggccccggacgacggctttccccagtgggacgcccaccccttgcggggcgggttcgccgcccggctgtatcccaccgtggcgcccgcccacacggattgctcggcccaggtgatcggcccggcgggaccggtggtgcgcctgcgcgccaccatcggccccgacgagatctcctattggggcctgcccgccctggtgacctggaagcccgatgccgaggccaagcatatcaagtcggggctggcggccaccctggaccacctgaccgcggcggccaaggccggcggccggtcgcggctggtgatcggcagcgccgcccaggccgatcccgatcccctggccgccctgctggccgatcggggggccgaggggctgatccaagcctccgcccaggtggatctcacccggccggaagagtccttgcgcgccgatatccgcgacagctaccgctcgctgaccaattggggcagccgcaacctcagcctgtccttcgtcaacgccgcccatcccgaccgcgccgccttcaaccgcttccccgagttccatgcccgcgtcgccggcggccggcggcggggcgacgactactggcaagtctattggaccgagatcgtcgagggccgcgccgaaatggtgctgggcttcctgccctcggaagacgggaaggacggcaccctggtcgccggctccatcgtggtctgggcggggggcaccgcctattacgcctcgggagtctacgaccgcgacaagttcgacaagcccctgggccactggcccctgtggaccgccatcctgcgggccaaggcggcggggctacgggccttcgacctgggcgagagcccttcacgaggccacgccgacgccaaggaagcctccatcgccttcttcaagcgcggcttcacctcgggacggaatttccgcatccgctgggtgctgggagtttaacaggcggcggagaaataccccttcgggggcttttgcccccgagcccccaaccgggcagcccagcttcccaggcccttcagttttttaaaaaagctggaggttcggaggctgtgcctccgaacgggtcagggcgggtgccctgccgcgaagcggggcttttaaacgtcgaagccctggggcttcccgcccttttcccacttggcccacatggtgtcgaaggcctgttccagcgggccgacgaaggccttgccgtcgaacagaggcgaggtttgggtcgccgcccacaggcgctgacgcacctgttccagggcggcccgatccttggccagatgctgggccagggcgtggtaggccccctgggactcggtgatcagctcgtccaggcccagggcatgcagcagcgagcccgccacccgcgaggcgaaggtgcggcccacccaggccaccacgggcacacccgcccacagggcgtcgctggccgtggtgtgtccggcgcaaggccaggtatcgaggaacaggtcggcggccgacaggcgagccatgtgctcggcctgggacaggcggggcgcgaagatcagccgggccgggtcgatgcccaccgcgctgatcatggcgcgcaggctggcggtggcggcggggtggaactccacgaaccacagcaccgcgtcgggctgcgcctgcagcacgctgatccacaccgccagggtctcggcgttgatcttgaaggtgttgttgaacaccgcgacgaccagggactcctcgggcaggccccacttggccttgggctcgcgggtcagggcgcgcggccggcgggaatcattgggctggtagcacagcggcaggcgcaccacctgctcggcgtaatcgccctcggcccccggcggaatcacgaagggatcggcgatgatgtaatccatgcaggtgccgccgaaggtgccgggaaagcccagccacgccacctggatgggtgccgggcgagcggccaggatggcggtgcgggcccggcccgtatgccccttgaggtccaccaggatgtcgatgccgtcggcggcgatacgcttggcgcaatcggattcggccagcggccccagttcgacccaatggtcgcaggcctcggtcaggcgggcgcgcaccgccccgctctcatgggggccataggaataggcgaagatctcgaagcgggatctgtcatggctttccagcgcctcggccagcagataggcggtggcgtgctcgtggaaatcctcggacagatagcccaggcgcagacgagggcggcgcggcgccggctgatgggccatgggcgccacccggttctcgatgaacgaggcggcctcgtcggcatggcggcgcagctcggccgggctgaaatcatgaatcaacagggtgaagggcgccaccggcaggctcttgccggtgcgccacgagggaagggcggcaatggcctccttgaccacgggaaggttgtcccagtcgcacaccaccgccagttccaggccgagatagcccagggcgccgccatcggcgccgccggtcagccgcaccacattgctgtaggccagggccgaggtctcgtggtcgccggtctgcgccgccagggcggccatgttgcgccagccgtccacataggaatcatccagttgcacggccttgcgatagcattccatggcctcattgggccgcccgtcggacatcagcacggtggcgagattgccgtggaaggcggcggctttcgggctggcggcgatggcgccgcgaatgaagcgctcggcctccttcaactggcccttctgcatggccaccaggcccgagaggtgcagaccgtcgggatggagcggcgcgatcttgagcaggctcttgtagagacccgccgcgccgtccaggtcgccggaaaggtggagcttcaccgcatcttgcaggagctggtccgccatcttgtgcttgccgccgctcaactgctgctccattcaccatacgcccttggtaaaggatagggtgcggggaacagggcgtcaacgcgttgccgcccgtttaaggttttctaaacatacggtttggcaagattccttcgcctgacgtatgattcgggaaagttccgaggcggcgatgggccgcgctcaaatgaagtcgggggaaatcgcatgtcccaacctatccagatcgaatcgctgaagatcggcgaacaggatgccttcggcctggtcgaggcggccatcaccctggatcagtcgcgcggcgacaaggcccgtctggccgcggccctggaacagaatctccagctgtgggtggccatccgcaccctggtctccgacgccaccagcggcctgcccgacgcggtcaagaccaacctgacccgcctgtcggacttcgtcgccgacaccaccttgaagaagggtgtcgagatcagcgacaacaccatcaccaccctggtgaacgtcaatctgcaaatttccgaggggctgctggaaagcgccaaccgaacctgaccgatcttccccttcacggcggcgatcttgccgccgcccaggcccggtggggccatcccgcccagggctggctcgatctctccaccggcatcaacccctggccttatcccctgcccgagctgccgtccgattgctggcggcggctgcccgaatccggccgccatcaggcgttgctggcggtcgccgcccggcgctggtccgttccggccaacgcccgcgtggtggcgggaagcggcagccaggccctgattcaggccctgccccgcatcacgccgccgaccgaaatcgccattctcggccccacctatggcgagcatgcccgcgcctggagcgccgccggccaccgggtgcgcgacgtggcaggactccaggaggccgccgcctccccggtggtggtggtggtcaatcccaataatcccgacggtcgggtcgtcgcccccgaggacctgctcgatctggccgcccggcaggcggcacgcggcggattgctggtggtggacgaggccttcggcgacgaacgcccggaattgtcgctgacctcgcgcctcggccccggactggtggtgctgcgctcgttcggcaagttcttcggtctggcgggaatccggctgggcttcgccgtggccgaagaggggctggccgcccgcctgaccgatcatctcggcccctggccggtctccggccccgccatcgaattgggcgcccaggccctggccgaccgggtctggaccgaggccaccatcacccgcctgcgcgacgccgccgcccgcctgggagacatcctgacgaggaccgggctggaagatctgggcggcaccttcctgttccggctggcccgtcaccatcaggcccccgccctctacgaacgcctgggccgcgccggcatcctggtgcgcgccttcgcctttcgccccgacatcctgcgcttcggcctgcccggcagcgaggccgacgagcagcggcttcgggccacgctggcgggctgaattcagatattcggaaacgcttcagacacacgaaagcgggcccggccaaaaggacgaacctcaacaggtcatgaaaagcctatgcggccctggcgcgatgccggccgttcttcccggatcaagcggcgaccggaatcgccgctcagatcttgaccgaaccgctggacggcgcgggcgcggcgggtgcagcaggagcactgggcgcggcagccaccggagcgggcggggccttcacatcctcgggagccggcgtggacgccttagcggaggattgcggctgttcgatcgccgtcgggatgttgcgcttgtactcttcgaccacgtggcgggacggatactgttcgacttccttgcccgtgtcgccgtcgcgaacgaccagcagagccagaccggttccactgtcgaccttgaccaccggagaggtgtagcggggaggctcggttacggacgcggtttccttggtctcgacagtcgcaggctgagccgcatgagccgccgcgtggggcgcctcggcgaccggtgaccggagcggagcgtcggatgcaatcgaggtggacattctgccctcctatttttggtgaactatgacaactgccgtttttcggaaaccacagagggactccgcccgacagcgccttctggcacaagccacagagtacaagattcatcctttgtgaagcaatctgattcttgacagccggccgggcttctgaatcagccaggggttgcttcaagatcggcggcgcgacgcgccaggcccggcggcggaagcgcaccgcccgccacatgggaccggcggtccagcatgatcttgaccgtggcgcgggcgaacatcttgagccgccccatcttgtacgcctcggacagatcgggcgacttgatgatgccgagaaagaagcgggagatctcccccagggtctgctcgcgcagctgggtgtcgctgtcgcggcgcagcagggcgcccaccatgtcctgggcggccgccatcagtgccagaccgtcggtctgggcgtcgagcagcgtgcacatctgctcgaacaggcgcctcgcctcttccggcaactggatatcgtcggccgcacgtgccatggaatccccctccctcaatgggggaatcatgacaggacaaagaccgaagcgccagcggtcagcgcagcttgcccggccaacgctcgtcgggcgacggcgcgtccacgcggatgggccggtcgcgcaggtcggcccggcgcacgctgccatccatggacaggggtaattcgtcgacgaactccatccgcgacggaacctccaccggcgagcgggtcaggcggacccaggcctgaagctcccgtgtgaaggcggcatcggctgcccgcccccccgccaccacgaaggccttcaactcgcccgacgtccattccagtaccgccgccgcgaccacgtcgggatgggcggccagggccagttccacctcttccggctgcacggggcaccctccgaccaggacggcgccctcgggcagggatggcggatcgggccacagatagtggtcgagatcgcgaaagcccgaccgtccggtgatcagccagccattgacccgccgcgccgcgccggcgccgtcgccccaatagccgagaaagctgcccggcgcgttgggcgacaccgccagcaggccgcgatcgccggcccgcaaggggcggccgcgctcgtccaccgcgtcgatggacagccccggcgccgcccggccgggcgagggcgggcgcagttccatcagcccggccagattggccgccacggcgccgctttccagcacgccccaggcctcgttggcatggacgccgaacaccttgatcacccgctcgtgcaggtcctcgtccagcggctcggggccgctggcgatggcgcgcggcatggcgtggggccggctggctgccgcctcggtcagggcgcccagatggtggggaggcacataagcggtgcgcacgccgtggcgcgacatgaggtccagggcctggacgggatcgaaggggccggggcaggccaccaccggcacgccgtgatgccaggcgggcagcacggcgcggaacagcgcctcggctcccatccactcgctcgaggtccagacgatgtcgccgaactgggggaagaaggtcagcgacatctccaccgccggcaggccgccggccatggcgcgatgggcgtgaatcaccccggccggcctcccgcaggcggcttcgggatagaagatgaaggccggatggtcggctggggtcaccaggggggtgaaggcgtcggagctgcgctccagctcggaccacaggtccagggcaccgccgccgccgcccaccgccagcacccgctccagctcgggcaggcgggaccgggcgcgctccagcgccggcagcgccgccggatcgaccaccgccaccctggcgccgctgtcggccagccgccagcccaggggctccgagcccagggacagcggcacgggcaccagcacggcgcccatctttgtgaccgccagcagggtaaccgccgcctccagcccggcgggcagcgccatggctacccggtcgccgggagcgatgcccatggcggccagcccgttggccagccggttggacagcaggcgcagcatgtggaaggtgtggcgctcgaccccgccatcggcggcctcgacgatcagggcggtgcgatggccgtcggccccggccatggtctggcggtcgcagacgtcgaaggccaagttgtagcgctccggaatcttccagcgaaaggtccggcaggcttcttcataggaacggcaggcggtcagcatgaatcgtcctcagccacccagcggcatcagttcctcgaaccactgataggttccgacgtcgtcgaacatgacgccatcgaatcccaggtccatgattccggacagatacttgcccagcaggccacgccattcgccgctgcccaggtcggtgacataggttcccggcccctcgtccaaggcgtagaggaaggcggggttgcccacttcccaccccttttgccagtaccagcgccagtcataggcccggcccagcggcatcaccgcgatggccaggcggcgcggccccagcttcttgaacttcaggcgctggatgtcggccttgaccagcagttcggccgagcgatgggccacgtccaccaggacgatgtcgtaattggtttcggcgatggcctcgatgaacttgcccttggtgccgaaccggtccgagcgcagcaccggcagccagttgcgggcatgggcgatggtcaggatttcccgggcattctcgaaggcgggatgggcgcgcggcgtctcgtccagcggccccgtcccgatcttggcatagggcgtcacgcgatcgcggatggcacccttgtaggcggcctcgcggtcggcgggcttgtcgcacatctcgatggccaggacgttgcgcccctcggagcggatggcgtcgagggcataggtctcgcgccgttgaatctcggcgcgggcctgcttctgcttcaactcgttgtacttgcgcagttcctcggccgggtcgttgctgaatggccccatctcgatggccaccggcggccggtggatgccgcgcttcttctcggcgtccagctccaggtccaggtcgcgccgggccttcagcacctcgtccaggggcttgccgtcaaaggcataggggccgcaatacaggccgtccatgacgatgccgtccagcactttgaccagcggccggaacaccgagcgcagcggcggacgcttgatgaaattggtgccggagggatcgtgcaggtcgtcccactccatctccagctcgcccttgaccagcagctccgagccgccgcgcatcagaacctggaaggcgggattgcgcttcttggcataggtgcccagctcgatgaccacgtcgcgggtctgctcgcggaaattggggatcatggagggcggcggcggcacgaagtcgcggggcggctccaccgccagggcgggcgaggcgctgcctagcagcaccagcgcggcgatcaggcgtttcatcatgcctattcctgacttgtcatcccgacgacctccgggaggagggatctcctcctggcacggcttttcaaggctggcaccgccgcgccaagcggggatccctcggcttggctcgggatgacaatcggagcggttagcatcgctcggtcgcgtcatgccagcaactcccccacatgcccggcgatggcaaggctggacgtcaggcccggactctcgatgccgtacagcgccgccacgccgggcactccggtctctcgcggaccatggatcaggaaatcggcggccggctcgccctcggcggtgatcttcgggcggatgccggcataggccggctccagcgcgccgtcggccagatccggccagtagcggcggatggcggcgtagaaggaatcgccgcgccgaggatccacctgataatcctcggcctccacccattccacgtcgggaccaaagcgcccgcgcccgcccaggtccagggtgaaatgcacccccagcccggcggccaccggcacgggatagaccagccgggtaaagggcgtgcgacccgacagggtgaagtaattgcccttgcacagatgggccggcggcacgttcttcaagcccagggcggcgcccaggcgcggcgaggacagcccggcggccagcaccacattgcgggccagcaaggtagtgggctcggccccgcccaccgacagcagcatgccgtcatcggtggcgcggccccctgtcaccggcgacttcagcgccagggcggcgccccgctcctcggcctcgcccagcagggacagcatcagcccatgggtgtcgatgatgccggtggccggcgaccacagcgccgcgacgcaagccaaatcgggctccatctcgcgggcatgggcggcggaaatgcgggtcagcccctcgacgccgttggcgcggcccttggccaggatggcgtccagttgggcggcctcggcctcgtcggtggcgacgatcagcttgccggtcatggcgtgggcgacgccccggctggcggcatagtcgcggagcaggcggttgccctcgacgcacagccgcgcccgcaggctgcccgccggataatacatcccggcatggatcacttcggagttgcgcgacgagatccccgagccgatggcgccctccgcctcgaggataatcacctcggcgccggcatgggccagggaccgggccacggccagccccaccactccggctccgatcaccacgcaatccacccgctcggcggcgctttgggtcaacaccttgttcttccccatcgaaggcacatctagatgtcgcggaggatagcatcggcggatcaagggttaaagacgcatcgccgttgcacccgccccccgccgtcgctagactccgctgcaacgcaccatcgccggatacccgcccgtgaccgtcaacaccgccctgtccgtctgtccccacgactgccccagcgcctgcccgctggtggtggaactccccgagccgggccgcatcggccgggtgcatggcggcgagatggcctataccgggggcgtggtctgcgccaaggtggcccgctatgccgagcgcgttcatcaccccgatcgcctgaccacgccgctgaagcgcgtgggcgccaagggcgagggcaagttcgcccccatctcgtgggacgaggcgctggacgagatcgccctgcgcctgcgcgaagccgccgaccgcctggggccgcagaccgtgtggccgtatttctacgccggcaccatgggccatgtgcagcaatcggccatcaaccgcctgcgccgcatcatgggctattccgagcaggccaagaccatctgctccaccgccgccagcaccggctggatggcggggaccggcgccaaatggggcgtcgacccgcgcgagattcccgaaagcgacctgatcgtcatctggggcgccaatcccgccgccacccaggtgcatctgatggggctgatcaatcaggcccgcaagcagcgcggcgccaaactggtggtggtcgatccctatcgcacccccaccgccgagaaggccgaccagcatctttgcctgcgtcccggcaccgacggcgccctggcctgcgccgtcatgcatgtgatgttccgcgatgacctggccgaccgcgcctacatggcccgctacaccgactgccccgagcggctggaagcgcatcttcaaagccgcacgccccaatgggccgccgccatcaccggcctgtcggtggacgagatcgaggccttcgcccggctttacggcgccaccaagcgctcttatctgcggtcgggctatggctattcccggtcgcgcaacggctcggtcaacctgcacgccgtctcgtgcctgcccgccgtgtccggcgcgtggcggcacaagggcggcggcgcctgccagagcatgggaggcgtcttcgacctccgccgcaccctgctggacgggctggatgtgcccgccgccccggtccgcatcctggacatgagccgcatcggcccggttctgacccatgaccccaaggatctggcgggaggcccggcggtcaccgccatgctggtgcagaactccaacccggccacggtggcgcccgacagcgggctggtgcggcggggtctggcccgcgacgacctgttcctggccgtgcacgagcagttcatgaccgagacggcgcgcttcgccgacatcgtgctgcccgccaccaccagcatggaacacgccgacctttacaccagctatggccacaccttcctgcaggtggccaagccggtgattgcgccggtgggcgagagccgcgccaaccaccgggtgatcgccgagctggcgtcgcgcctgggtgccatccatcccggcttcgagatggacgagtgggagatgatcgatcaggtgctggtggcctccgacctgcccggcgccgaagaactgcacgtgctgggcggtctcgactgcgccaaggtgttcgaggacgcccatttcctttcgggcttcggccacgaggacgggcgcttccgcttcgcccccgagtggaaggcggaagggctgcccgaactgcccgaccatctggcggtgaccgacgcggcggacgaggcccatcccttccgcctgatcaccccaccgtccaggcacttcctcaataccagcttcaccgagatgcccacctcgcgggcccaggccgggcggcccaccgccctgatccacccggaggattgcgccgccttaggcgcggccgagggcgacatggtccgcatcggcaattccaaggccgacatcatcgtgcatgccaagcccttggccggcatcgcccgcggcgtggtggcggtggagggcatctggcccgacgggttctttgccggtggcaagggcgtcaaccacctcaccagcgccgaccccgctcttcccggcggcggtgccgtctttcacgacaccaaggtctggctgcgtgcctgtcatcccgagcgagagcgagggatctccgcctgatacggcggtgccggattggaaacgacgcgccaggatgagatccctcctcccgatggtcgtcggcatgacattgaaagggaagccatgagcaagaaagcccacgtcatcgtcgtcggcaacgagaagggcggcaccggcaagtccaccatctccatgcatctgatcgtcagcctgctggaccggggcctgtcggtgggcagcatcgacatcgacgcgcgtcaggcgaccctgacccgctatatcggcaatcgcgccgcccgccaggaccggaccgagctgagcctgcccatccccgagcacatggccattccgcccaccggcgacgcgagcgccgattgcgcccggctggaggaggtcttccgggacttcgccgcccgccacgacgtggtggtgatcgacacccccggcagcgaccaccccatgtcgcgcctgggccattccttcgccgacaccctggtgacgcccctgaacgattccctggtggatctggacgtgctggccctggtggagccgggcagcatgaagatccgccgccccagccattacgccgagatggtgtgggagaccaagaaggcccgcgccatgcggggcgaaaaggcggtggtggactggatcgtgctccgaaaccgcctgtcgaccctggacgcccgcaacaagcgcgacatggaaaagctgctggccgatttgtccaagcgggtcggctttcgcgtcattcccggcctgggcgagcgggtgatctaccgctccatgttcctggaaggcctgaccctgatcgacctgaagaagaagccgctgggcttcgacttcaacatgagccacgtggcggcgcgccaggagctgcgcaccctggtcgaggccatcggactggggcagccgggttaacgcttcaacgccaggagcagcacgccgccggtgatcagggcgataccgctccaatcgcgcagcgaggggcgctcgcccaggaacaggacggcgaagatcgccaccagcaccacgctcagtttgtcgatgggcgcgaccttcgcggcctcgcccagcttcagggcgcggaagtagcagacccacgacgcccccgtcgccagggccgacaggacgatgaacccccaggcgccggccggaatcagggtgggatcgctccattttccggtggcggccacgaacagcgccagcaccaccagaatcaccccggtgcgcagcagggtcgccatgtcggactcgatgcccgccgccagaccggccttggcgaaaatggcggtcatggcggcaaacaccgccgacagcagcgcccaggtgacccaaggtgaaaccgagcccatctccgacctcatcgggttgaccgtcagtcggtgatcatacacccggtcgaggccaaatcccgatgcgttggactcatcgggatccggcatcaatgccgtgccggcggccttgccccctgggggtgctggatgatcacgccgtaccagcccagtccctcgtaggtctcgtagcccggagtcagggaatagccggtgaccatgccctgctcgtccacataggagccggccggtccctgccgggtatcgagcggcacccgctcggtcagaacaccgattccgtccgaggcggcgatcacccggaactcctggtcgagcagcagacatcgggttccggccttttcctcctcgcgcaggcgcacgcccttgaccacggtctcggcctgggcctgccagtcgaagaaaatgcccagcgccccgatcacccggccgtcgttctcgccgccctcgcggatggcggcgctgtaggtggccacctgggcgccgcccagcggaccgttggtggagatgtcggccacggcgtattcgctgccgtcgcgggtggccatggcgtcccggaaccacgattcgcccgagacatcggcgccgatggcccgcggatagcggtcggggcggccgctggccaccacccggccctcggcgtcggcgatccacaggtccagatagaccgtgtaggaatcgagaatgacccccaggcgcttgcaggcgaaattggctgcgtcggacgtgcccccggtcagacagtcgaccacggcggaatccgtggcccaccagcggacgtcgcacgagcgctcatagaggttgcggtcgatgatctcgatcatgttcagcgccagatcggccaggcgcgagccgcgcagctgcttgaccatcacctggcccagggtcatcaggtcgttgatggaggacgacagctcgccctccagcgactgggtgatggtgttgatgttgtcggagacgttcttgacctcgttggcgaccacggcgaagccgcgccccagctcgcccgcccgcgccgcctcgatcagggcgttcagcgacaggatacgggtggtgcccgtcaccttcttgatctcgctgatcttgtcgttcgcgacggtgtgcaccgcctgggtcagttccaggattcgttccggctcggccatgagtcccccaactgctgcctattttcttgtcagaagtatgctctagcttcttttttaggcaattgatgcagggaataccaacaaaaaatgccccgccggggagcggggcatcggtaaccatacttatgtctgaggcagatcagtcctcgcggtgagtgcgctccagccgctcgtgacgctcctgcgcctcgatggacagggtggcgatggggcgcgcctccagacggcggatgctgatgggctcgcccgtctcctcgcaatagccgtaggagccgtcggcgacccggccgatggcggcatcgatcttggagatcagcttgcgctcgcgatcgcgggtccgcagttccagggcacggtcggcctcggccgaggcgcggtcggcgatatcgggctcctgcatgccgccttcctggagatgctgcagcgtctcgtcggattcccgcaagagctccgcccgccaccgcagcagcttctggcggaaatattccttcatggtgtcgttcatgaagggctcgtcctcggacggaacatagtccggcggcaacatgacggtcatacgatccctcgaattcctgatcggggttcaagtcgcagcgcaatatatggatagggaagcacccccgcaagcgccgtcttgcacggcgacactccggcgaagggtaattctgcgtcaggacagggaaaatcagccgcgcggcgacagcttggccaactcaacctcgacgcgaagctcgatctcgtcgaggatggcggccagccgcgggtcgccgcaattctcgcgccgggcccgcacattctgggccagggccatcatccggccggcggggatttcccccatcagcaggccgtggcgcagttcttccagaccgtccagcaattcctcgccacggcggaccaggcggcggcgcgcctcgcgctcgacggaattgtccatctgctgcaccaccagaagggcgtcgatgccggccatgcccaccggggcctcgacggcatgcgcctcctccatcgaatccatggattcgatcagagccttcttgaacgcacccttggcgcccgtgctttcggacttcttggtgccggagacggcacccttggagcccacgcctgaaatcttcatgccctgactctacccggttgggccggaacgtgacaggcgttatttcgccagagccggcgccctgggtcaactgggcaggttttgccgggcaacacggcgtttcatgcccggccaaaaccgccgctccgccccaatataggcaatcacctcattgttttaaaatgattttttctttggcatgggtttcgcaagggagggaccgcaagacccatgaccccattcgctgggaagaaaccgccatgaagccctttgcccgccgagccctgctcaccgccgaaccgatccgcgccctgctgctggccgcctcgctgctggccgcgacgctggggctgatgcccgcagaagccttcggggcgtcgcgcatcaaggacatcgccgatttcgaaggggtccgcgacaacatgctggtgggctacggcctggtggtcggcctcaacagcactggcgactcgctcaccaacgcgccgttcaccaaggaaagcctgaccggcatgctggagcgcctgggggtcaacatccgcgacaagaccggcgccatcagctcgcagctgacgccgaagaacgtggccgccgtgatgatcacagccaccctgccgcccttctcgcgccagggcacccgcatcgacatcaacgtctcggccatgggcgacgccaaggacctgcgcggcggcaccttgctggtcaccccgctgatcggcgccgacggcgaggtctatgccgtgggccagggccaggtggcgaccggcggcttcaccgcctcgggcgcctcgggctcgtcggtcaccaagggcgtacccaccgccgggcgcatcgccaacggggccatcgtcgagcgcgagctgcccttcgagatgtcgcacctggaatcggtcaaggtcagcttgcgcaatcccgacttcaccacctcgcgccgcatcgcccaggccatcaactcgttcctgggcggcgacatggcgcggccggtcgatcccggcacggtgcagatcgccgtacccccgggctatcgcggcaacgtggtcggcctgctgaccgatgtcgagcaactgcgcgtcgagcccgaccagatggcccgcgtggtggtcgacgaggtctccggcaccatcgtcatgggcgagaacgtgcgcatcagcacggtggccatcgcccagggccagctgaccatccgtatcaccgagacaccgcaggtgtcgcagccctcgcccttctcagacgcgggcaccaccaccaccgtgcagcgcaccgacatccaggtggacgaaggcgccggcaacaagctggccgtggtcccccacaaggtcaccctgcaggagctggtcgagggcctgaacagcctgggcatcggcccgcgcgatctgatcaccattcttcaggccatcaaggcggcgggcgcgctgcaggccgagctggaggtcctgtgatgagcattcttccctccaccgccgccacgccctacatcgacaacggcatgcccggcatgaagatgcccaaggcgggcgccgccgacaccgccaaggccgccaaggccgggcgccagttcgaggccatgttcatgggccagatgatcaagagcatgttcgagggcatcaagaccgacggcatcttcggcggcggcagcggcgaggagatgttccggtccctgctgaccgacgaatacggtaaaatgatggccgccaaaggcaacggcatcgggatcggcgccgccgtccagaaaatgctgctgagccaccaggaggtgcagtgacatgaccgacgaccgcgatcttcacgaccacgacctgctcgacgacgacgagcttcgggccgcccaggccgaggccgagctgttctggtacgacgacctgctgttcgcctgcagcaatctgtgcgacctgctcgacatcgagaacgacgcgctgctcagccacgacccggaaacggtgcggctgctggccgacaacaaggccgccctcgcccgcctctatgagcagtcggtccagcccctgatggacgagcccgacctggccaccctgctcgacgacgaccggcgcgagatgctggtggcggtgggcacccggctcaacgaactgatcgagaccaacgcccggcgcctcaaggccgagatggaagcctatcagcgcgtgatggacatcatggccgacgccgccaagaagaacgtcaccagcaccaccgcctacggcaaggccggcatcttcgacgccaatctcggcgccggcggctcgctgtcgttcaacaaggccctttgacgccttcataaggcggggaagagaaatcatgtcccttaccctcggactcaattcggctctctcgggacttctgaccaatcagaagggcctggacgtcatttcccagaacgtggtgaacgtcaacaccaagggatacgtccgcaagcagatgactccggagtcccgtgtggtggccggcgtgggcgccggcgtgcagcagggcgcgctgacccgcaacgtggacgaaggcctgatgcgcgacatccgccgccagacctcgacccagggcgcccttgacgtcacccagacctattacccgcgcctcgaggacatgttcggcacggtcggcagctccaactccatctcgcaccagatcgaaaccctgcaggcgtcgttcgagaccctggccacccaggtcaacactcccgccttccagtcctccacggtccagaccgccaacgacatgacggaccagttcaacgagatgaccacccatatgcagaacctgcggctggaggccgaccgggcgctgcacgacaccaccgggcaggtcaacaagcagttggaggacatcttcgacctcaaccagaagatcgtccgcaacaacgccatcggcggggatatcggcgaccttcaggacaagcgcgacaacgcgctgaccacgctgtccaagtacatggacatccagtatttcgagcgcggcgacggctcggtgggcgtcttcaccaagagcggcaagaccctggtggacaaaggccccgccgtgctcagccacgtggccaccaccatcaccgattcgtggatgacctcggccggcggcaatttcaacaagctgacgctgagcaccacggattcccccgatgtcggcgaggacatcaacgatggcgaggttcgcgccctgctcgatctgcgcgacaccatcgttcccaaccttcaggcccagatcgacgaggtggcctccaagctgaaggacgcggtcaaccaggtccacaaccgcggcaccatcttcccgacccaaagctcgaagatggtcggcacccgccagctggcggaccccaacaatccggcgctcaacggctcgaacccccagaacatctggttctcgggcaacgacgacaccaccatcgccctgttcgacaccaacggcaaccagctggcggccaccacggtgcgcaccatcatgagcagcaccagctacaccgatgccgccggcgccgccaccgccctcgacatctcggacgcggccaccacgcccggcgtcaagatgaccgacgtggccgccaagattcaaagctggatgcgccagcagagctaccagggcaacatcatgtccgcggccagcgcctccgtctccaccggcaccctggtcctcgacaccggcgttccgtcggtgaccctggccttccgcgaccagaaggccaccgccgccggctcggccgccgccgatgcccgcatcaatttcgacgtggacggcgacaacaaggccgacaagcaggtggccggcttttccaacttcttcgggctcaacgatttcttcacggcgtcggtgcccaattccatcgtcgattccgacgtggtctccaaggacttcaccctgggagcggcccgcagcttcacgctgtccgatcccacgggcaagatcggcaacaccatcaacatgtcggccgggtcgtcgctctacgacatcgccaaaaagatcaatgcccagacccagaccaatgaatcggccaccctgtcctcgtcgtccctgaccaccacctcgacgaccaacatcaccatcaacgatgccaacggccgggtgacccagctcagccttgcctccggcaacatgacgctgaaggacatcgccgacgccatcaacgcccagggcagctcggcccaggcggcggcggtgcaggaaggccccaacgcctatcgcctgcgggtctgggacagccgcggcgtgccgctggacgtcaccgtcaacggcggcaccatcggcacctcggacatgaagtcctatctgggcctgcagccgtcgcagctggtcgaggcctcggtcattcccgaaggcgccggctatcgcctgcgcatccgccagacctcggaccgggaactgttcctgggcgccactcccgacaccctgacgccgtcgggcagcttcatcaccgaactgaagatgcacaccgcgtcgtcgcgcaaggccggcaccatcgcggtgcgcaccgacatccagggctcaccggccaaggtcagtcgcggctccatgcagtacaacaccgatctcggcaagtacttcctgtccgaaggcgacaacaccaccgccctggcgctgggcgccgccatgtcgtccaagaccgacatggccaccgcgggcagcctctacgccggcagctataccttcgccgagcacgccgccgcctccatcgcccaggtctccaccgatgccgcccacgccaaggaccgtcaggactaccagaccaccctgggccaggcgctcaattcccaattcgcatcgaccagcggcgtcaatctggacgaagaggtcgccaatatgatcaacttccagcaagcctattccgcgtcggccaaggtgatctcgacgctgcaggaaatgctggatacccttgtcaatatcgtgaagtaagggaggccgatcatgacccgcatcggcacgctcggcgccaacaacgccttcgtcaaccggatcttggatatccagacccggattcagaccgaacagattcaggtgacctccggcctgaaggcccagtcctacgacgggatcgccgccggcaccaacacggtgatcaatttccagaacgaacaggccatcgcccaacgcttcatcgacaacaacgatgtctggaacaccaagctggaggcggcgaccaccgccatcgccagcgtcaagaagacgctgaccatcttccgcgattcgctggagtcgtttcggcagaacaatcccaagaacgaacagaacatcaagggcatccagaacaccgccttccaggcgctgcagagcattcaggccgacctgggcaccaacgtcaacggccagtatctcttctcgggcggccgggtgtccgacgtgcccatccagttgcccgccggcagcctgtccgaattccagtccatgtatgacggctccatcaacaccttctcgaccacccgcaacgccgacacccaggccgtgtcgctgaccaatgtcgagacctcggccatgagcttcaacggcgccaacggggtgatcactccggcccgggccgacgccttcaagaccatctatcccggatcgcgcatcaccgtctcggacagcaacgtgtcgccccccaacaacggcgacttcactatccggtcaaaggccatctgcgacctgaccggcactccgctggccgagggcagcaccaccaccaatgtcatcagctatggcagcggccctggcaccatcctggacaccgccaccaaccagctgaacttcgccttcgcccccgacggcaccatgaacatgaccgccgccacggcgggctccctggccaacctgacggtgggaaccaagttcaccatcggcccgcaactgaacaacggcgcctcgaccaccggctacgagggctcgttcgaggtggtcagcaacaagaacggcgtggtcaatttccgcaccaattacgacacggccaaggacgaagccgtggcctccaccgacctgaccttcggcatcaacggcggcgccatggccaatccggccacggcgggcaccttgaacttcaccaccaccagttcggccgtcaccggcaagaccacggtgaccctgaccgccgctaccggcgcgaccatcgatttcagcacggtcagcgtcggcgaccagctttccctgggtggcaccgccggccacaacggtaccttcacggtgaccaacgccaccgccacgtccgtctcctttgagatcaatcccgaaggggcgcgcatcgcccagttcctgccgcagaccgggcgctcggacgtctccatgtcgttcaaggacaccaatgcgggggcgacggtgacccgcaacaacaccaatttcggctcgctgaccttcgcctcgacgggcaccctgggcgagcgcatcacctcgtccaatgccaacggcttcctggacgacggcggcaacccctacccggccaatggcaccatcatcaccatgaagagcacgtcgggggtcaacgacggcgtctacaaggtggtggccaacaacggcaattacatcgagatcgccagcgccagcctgaccacggaaaccctgtcgaccaagaccaagatcgattcaagctcgtggtacaagggcgacaccctgcagctgcagcaccgcgtcgacatcgaccgcacggtggatgtgggcatctacgcctcggacccggccttcgagaagggcatccgcgccctggccctgatcgcccaggggcagttcggcaccgccggcggcctggactcccaccaggagcgcatcggccaggccctgtatctggtcaacgactcgctggaatcgcccgcggccggcacgccacccttcggcacggaaaaggccggcgacgtcaagtcggtggccagcctgctcgacggcacccgcaagaccatctcgctgaagaacgagaagcacaaccagttcatcggcttcctcagcaagcgggtggccgacatcgcccaggtggacaagaccgagatcgccaccaagatgctgtccgaccagacggcgctggagggcagctaccaggtgctggcccaggtcaagaacctgtcgctgctgaattatctgaagtagtcccgacgccccaatgaccgcgacctgcggtgattggggcgcgcgcggacatcaatcctggacgacggcatccgcggcggcgacgctctgcagcgaacccaggaccttggtctcgtgatcgagcaggtggcgggtagccttcagcgccttgtagtaatggccctcggccaccgcctcgttgatctcgtccttgatggcggaggcgctggggcaggcctccacatagctgtcgagatagtggttgaacatgcgcagatattcaccgcgcttggtcgggaagatataggcgcattgcagggcgaagtagacccgcgacgccggggtcacgctgtcggaatcagagaggatctccttctgacgcaggatcgagcagtcattcagcacccgcaccttggtgttggaactggcgttctccagcaccgcgccgttgatgatgagcttctcgcccggcttcagatcgataataagcggcaacgcaacgcactccgttctttggtggcggcgacaatggcaccaagcgccatgtccggcaaccaccggcaagtatggctcgacctccggcccaagccctacagctaaatttaggtcaccagccgcctttttccagccaggctcccaccatccataaacggtcggcgccccaaaagccttcgccgtccaccagaaaaaacggcgagccgaagacgcccttggcgatggcggcctcggtttcctccttgagacggcccttccactggggggattggatggccgcggccatctcgtccgggtcgatgcccaggggcacgcccagggcacaggccacctccgggctggagatatccatgttctcggcgaaataggcgaggtagaccgcccgggcatagctcctggccaggtccttgtcccggccctccagccaccaataggcccgcgaggggggcagcgccggaaccgggaaggggtcgggcaggcgatagggcgcccccatcagccgcgccacgcgttcccagtcgtggcgggaatactcgcccttcatgggctggctgaccagcggcaggttgcccgaggccttgaaggccgagccgatcatgatcggcttccacgccacctcgcggccgaaggcggccaccagctcgtccacctccagggaggcgaagtagccgtaaggcgaggcaaaatcgaaatagaactccaccggctgggtcatgctttgctccctaccaggacaggcgagacccatcgtaatggatgaaggcgccgctgtccccggccgtcagcccggccatgacctttcgcatgccggccacggcggtctcggcatccaggggagcgttggccccgcccatgtcggtgcgcacccagccgggcgacagcgccacggtgagaatgccgcgcggcgccagatccaccgccagccccttgatcaccatgttgagggccgccttggcggcgcggtaggcgtaggacccacccgaggtgttgtcggacatggcgcccatcttggacgacaccgccgcgatgatcctggccccggtcatctggtcggcgaaggcttcggccagcttcagcggcgccagggtgtcgacggcgaccaccttcatgaaggcggcggggtcgacggcgccgaactcctgcttctcgccgtagatgccggcattgttcagcaagatgtccagccccaccccggccagcgaggctttcagccgcgccacctgggccgggtcggccacgtcgcagacatagacctcgccgcccgcctcggacaaggcgcggcccgccatgggatcgcgcaccgtgcccagcacccgccagccctcggcggcatattgccgggcgaactcaagccccatgccgcgattggcgccggtgatcaggatggtgggcatgatgcgtcctccgttggttggcgggcaggatgcccgcgctccatgcccggagcgcggccgtccccgccgctctttacgccttgagagcggtgacctcgatctccaccttcatgcgcggatcgaccaggccgcagacgatggtggtgttggccgggcggatgcccttgaaggccttgcccagcaccggggcgatctgctcgaagaaggcggcttcggtgatgtaggccttgacgcggaccacgtccttcagcgacgcgccgccctgctccagcgcggcggcgatggtggcgatgcactgctcggcctgggcgaccacgtcgtcggcgatctgcccatccttgaagcccgaggtgccggagacgaacacccaggggtcctggcgcacggcacgggaatagccggccacttcctcgaacgaggaaccggaagagatcagctgacgggtcatggaacggtccttaagacagaaatgatggaagacagcttcatagcgtatttcgggtcagcccgccaagatgcgctcgaggaacggcacgcggccctcgcggtcctccacctccagcacccagaggtcggaatccacgtcgcggctgcggcggatataggcgtcggccttgtcctcgggcaccggatcggggccggtggcgcgcagccacgccgcctcgcccgccccgtcacgcacctgggtgaagacctcgcagccggcggcgccgcggttgagcttgaccagcaccgccccggcatcctcgtcgcccttggccaccacgaaagccggaatggccagcacggaacagcggcggatggtggcatggacccacagcttggccttgagccggggctgggtcattgtttgagaaggaacacggttgttccgctcccagtgcctgtcatcccgagcgaagccgagggatctccgcctgatgcgctgtcgccgaacctgtcaaggttgagcaggatgagatccctcctcccgatggtcgtcgggatgacattccgaactttcagtctcggctcgctcacaccggttccttttccttgggcggggcggcgttcttgtcgccggcgtggtcggcctgggccatacgggcccgggcggtttcccagatgacttccagcagggcatggtcgtgggcgacgaatttatggaagtcgcgcgcatcgaggatcagcaactggcagcggctgaccgccttgaccgtggccgtgcggggacagcgttcgatcagggcgatctcgccgaagaaatcgccgttcttcaagatgaaggttccggcccgccccttgacctccacctgtccgctgacgatgaaatacatgcactcgccggtgtcgccctcgcgcatcagcacctcgcccttgatggcgcgggccagcttcagcagcccggcgatctcggcgatctggctggcctgcaggcgctggaagaacggtaccttggccaccagatgccaggtggagacgaaattctggcgcttcatctcctcggcgaagcccgacgccaggatcgaggcgggcagcgcgaacatgcacagacccaacaccgccaccacgctgccgaacagcttgccaaggggcgtgatgggcaccacgtcgccgaagcccaccgtcgacaaagtgacgatggcccaccacatggcggccggcacgctggccagggccggattggccccacgctcggtgaaatagatcagcgtcgaagccgagatggccaggatcaacatgatgaacagcgaggccagcagcggccgcaattcatgcagcaccaccacgcccagggtttccagggcgggggaatagcgggccagcttgaggaagcgcaggatgccgaacacggtctcgccgtcatggggcatcaaggcggtggcttcgcccaccaggaagggcaccaccgccaggaagtcgaagatgccgtagggcgaaagggcatagcgggccatggcggccaggcccgactccccgtccccccgctgagcccgggcgaccaccagccgcaggatgtaatcgagggacaggatcaccaggaacagcccgcccgtcgccgagacggcgccttcgaacccgatccaggcgtccggcaccgtgtcgacgatggcgatggtggtggacagcacgatgcagaccaccagcaatccccggtagaccatggcacgcatggagggaaacggcccctctcccaccaatccgtaaagccagtcgatcatggctcccccttcgatccggcaatactatagcgatgccacgccgagggtgcatcgtcggatttacgatgaaagccgaggccccctaccccaaaggcagggagaactcggccaccaccggggcgtgatagctttccggcggcgcatgaatggtggcgggcgagaccagttcgtcgcccagggtctcgttgtggatctcggctcccaggtaccatcccagcagcggccgcgacaccaggatgtggtccagcatcaccggtcggccgtgatgaatcaccgaatagcgctggccttccggcaggctgcgctccagcggcaccagcatgcgcatggccagatggccgttgccggtgtcctcgtcgtcgcccttgatgatgcgcatgccggcctcgtgctcgccggcattgaagtcgccgcacaccaccaccagggcatcggggcgggcgtcgaagatttcctcgaccagcaggcggacctccagggcctgtcccgcctgcttgaccccggccaggaagtagccctcggcccagccgcccaccgacagccagcggccgaaccgctccttttggccctgcagccagacggcgcgcggcgcacgcagatggacgttgatcacgtgcaacgagcgcccgcccggcaggccaagctcggcgtgcaggatcgggcgatcccattccacgcgctggggctcgtccggggcgggattggcccggaccgggcgataggcgcaaggtgggaccagatcgtgccagacctggcggtgtgcccggatgggcatcttggaaatgatcaccagattgtgcttgtccgacggatggacgccgccgcggttgaggctgtggacccggtgccagtgctcgtactcggtcccggccagcaggcggtcgagggcggtgaaaagcctcggcccgctcttggtgaccgaatgggtgttgacctcctgcaggcacagcacgtcggcccgcaggcgctggaactgcggacgcatcagcgccacccggtcgtcgaaatcgattccgcccgccgggcgctcgtccagattctccagattgaaagtggcgattctcagcggcgtcacgtcgtcctccctgccgccttgagtctaccatcatccaccgccgcctcgacatgcggaatgcttgtaccctttaggatgtagggtatagtgggagcggacgggaacgcaggggcgggggacccgatgacatcgatcgcgtggagcgaggctttcagcgtgggcaattccctgctggattctgaccaccggatcctttttgacctgctgacgcaactgttcgacgccaccgataccggccagagccgcgacgtggtgggcagcgtgctgtccgccctttctgaatatgcagaacaccatttccgtcgggaggaagccttattggccgcctccggataccctgatatcgaaattcacagggccgaacaccgccggctcgaagatcatgtgcgcgacatttccgggcgctatcgcgccggagaacgcggcgtgctcgacgaacaggttgtggaattgctcaagaagtggttgacccagcacatccaggttacggataaatcatacaagccgtgggttgagcggacagcagatggcggaaccataccgccgtcggtgacatgagggacgccagacagtcatgacgaccgagcgcaaattgttcacggccgagatcaagcggcttcaagagcgtggcgtcgcgacgcccaatgcctccaattccgaggtcctcaaagccatcaacgatctgcgtggcgacatcaagggcctggaagcgctggtccgcggcgaggcgccgccgccggtggcggccgcccctatcgacgacgtactgccccagaaggccgccgaagtctccatgctgaagacggaactgcgcgccctggctgtctgcatcgagcacaccaaggcggaaatcgccgcgctccgccccaaggacgccgacgacgaccggctgattgccgtgaccttcgagctggacgccatcgtgtcgtccaccgaacgggccaccgagcagatcctcgaagcgtccgaaaagatcgagaccatcggccgggaaatccgggcgcatgccgccgattcctatgtgggccgcctggtggaggacatcaacgacaccgtcagctccatcttcgaggcctgtaatttccaggacattaccggccaacgcattaccaaggtggtgaagaccctgaaatacgtcgaggcccgcatcaacgccatgatcgaaatctggggaccggagaacatctccgatgtctcgcccaagatcttcgaggagcacaaggacgacgattccaagctgctcaacggcccagccctggaaaaccagggaatctcccaggacgagatcgacaagctgttcgggtaaatacggcaaacacccgacacgaaccaagtatagcgacaataaaggcctccaaattccggaggccttttcttttgaacgccattcacatatcgcggcacttgacctgctctctccaggccctaaagtggggccgcgtcagacggccggacggccgccctcggattcacctccgggggaggaaagtccgggctccacggaatacacggtgccggataacgtccggcgggggcgaccctagggaaagtgccacagaaagcaaaccgcccgctcccaggccttcgggtttggcagctggtaagggtgaaagggtgcggtaagagcgcaccgcgcgaccggcaacggaagcggcacggtaaaccccaccgggagcaagaccaaatagggacggcactgttcttcttcggaaggacgaaacgcgtttccgcgtcgccgtccgggtcggtcgcgagaggcgtccggtaacggacgtcccagatgaatggccgtcacccgctttcgggcggggacagaacccggcttacaggccgtctgacgcatttcccatgaattcccaaaccatgccgccaaccctcgatggggcgattcgggcctctgttcacgatgtggtcccgcccgggtttttccacccttcggactcctgattgtgaaaaattagtaaatatcaaggtgctgcggggcgttcctcgagtactttagtaaaaacttgccagcattgttcctaattgcctctttcccatgcgattactatccgattccattgactcccatgatttcccatgatatcccattaatcaccatcccatcggggcgcacaggtgtattgcgccctgggggacggagcaggggttttcgggcacagcaagcggaaggcggacgagggtggcactcttcctctccacattcgtcaatagggtcgataagaagggtcgggtctccgtccccgcgacctttcgtgctgccttggccgcccaaagcttcgccggcatcgtttgctaccgctccttcaccaacgcctgcatcgaaggctgcggcatggacttcatggagcgcctgtccgacggcgcccagagcttcgacgccttttccgccgaacaggaggatctgtcggccctgatcttcgccgatgcccgccagttgccctgggaccccgagggccgcatcgtcctgcccgaggacatcctggcccatgccggcatctctgaatccgtgtcctttgtcggcaagggccagaccttccagatctgggcgcccgacgcctataaggcggtcgaggccgagattcgcgcccgcgccctgcaatcccgccccaccctgcccctgcgccccagggtgtcctcgtgagcccgcaaccccacatccccgtcctgctggccgaggtgatcgccgcgctggcgccccggaatgacggcgtttacctggacggcaccttcggcgccggcggctatagccgcgccatcctggcggcctcggcctgccgggtgtgggccatcgaccgcgaccccaccgccgtggcgcgcggcaagcttctggaagagggctcggccgggcgcttttccatgatcgagggccgtttcggcgacatggactccttgctgcgtcagcagggcgtcaaccaggttgacggcatcgccttggacatcggcgtatcctccatgcagatcgaccagccggaacgcggcttctccttcgccaaggacgggccgctggacatgcgcatggagaccaagggtcccagcgccgccgacatggtcaacgacacgcccgagaccgaactggccaacatcatctaccgctatggcgaggagcgcctgtcgcgccgcgtggccaaggccatcgtcgaggcccgccgcctcaagcgcttcgagcgcaccggcgaactggccgaggtggtccgcaaggtggtgccgcgctcgggcgacggcatcgacccggccacccgcaccttccaggcgctgcgcatcgcggtcaacgacgagttgggcgagctggagcgcggcctggaagccgccgaacgcctgctggcccccggcggccatctggcggtggtgaccttccactcgctggaagaccgggtggtgaagtccttcctcaaggcccgctcgggcgaggcggcgcgcccctcgcgccacgtgccccaggcccagggctccggccccgccgccagcttcgccctgctgtcgcgcaaggccatcggccccgccccggacgaagcccgcgccaatccccgcgcccgctcggccaagctgcgcgccgccgcccgcaccgccgcccccgcctgggagaccgtatcatgaggcgcggactgaccggcaccatcacctggaccctgctggcgctgtgcgtcggcgtggtgctgttcgtggtgaaatacgaggtcaaggacctggaggcgcgcctggccgggctgaacgccgagattcaccgcaaccaggagaccatccacatcctgcgcgccgaatggagctatctcaacgaccccatccgcctgcgcaccctgtccgagaagcacctgggcatgaagccggtgacgccgacccaggtggcgacgctggacaccctgcccaaggacggcatccccgccaccggcgtggtctacgccgccgtctccccgtcccgcctgtccctgccggtgcaggcccccgccgcccaggcgcccaagcccgccgctccggtcacgccagtcaagctggcggaaggcccggccaagccccggccggtggacaatgcccgaccccagccgggcaagccgcaaacgcccaagcccggcaccgtcaccacggcccaaggtcccacggtcaaacccctggacgcccccgtggcggccccggctccggcccctgccctggcgaagggcggccggagcatcgtcattccgtccccggccctggcccaatccgagcagggaggggcacggtgagcatcttcgcgccccgccgccacactccgggcttccacgccggcgacgaccttcaggccggcgccgcgcttcgtctggacggcgtgcgcatgcaggccatcgagaccggccggtcgcgtctggtggtcaccgccatggtcttcctgctggccttcgccgccatcggggcacgcatggtcgacgtggcggtcgtcgaccgcaatccgcccaaggcccacgctcagccccaggcccgcagcgacgagcttcagatggaacggggcgacatctcggaccgtaccggggtgctgctggcctcgtccctgcccaccgtctcgctgttcgcccggcccgaggatctgaagatcgccaaggtcgacgtggagaacgccgccatccgcctggtgaccgtgctgcccgagctggacctggaagagaccatcgagcgcctgtcgtcgggccgtcagttcgtctacctcaagcgcaacctgacgccccgccagcaatacgacgtcaattccctgggcattcccggcctgctgttcgagaagggcgagcgccgcatctatccccacggcccactggcctcccacgccgtgggcgtcaccgacgtggacaacaagggcgtggccggcatcgagaagcgcttcgagaacgcgctgaaggaaagccgcgagcccctggcgctgtcgctggacatccgggtccagaccatcgtgcgcaacgagctggcccgctccatcgaggagttctcggcggtgggcggcaccggcatggtcatggacgtgcgcaccggcgagctgatcgccatggtcagcatgcccgatttcgatcccaacgatccgccggcgcccaccgatccgtccatgttcaaccgcgccaccaagggcgcctacgagatgggctccaccttcaagctgttcaacaccgccatggtgctggacaacggccgggccaacctcaattccagcttcgacgccagcaagccgctggtcttcgccggacacaccatccacgacgaccacgccctgaaccgctggctgaccattcccgagatcctgatccactcgtccaatatcggctcagcccgcatggcgctggatgccggcaccgaggtccagcgcgccttcatggcccgcatcggcatgctgcaggccccgccgctggaactgcccgaggtgggggctcccctggtcccctccccctggcgcgagatcaacaccgtcaccatctcgttcggacacggattgtcggtgaccccgctgcaattgctggccggcaccgccgccctcgtcaatggcggcgagtaccacgcccccaccctgctggcccgcgccccgggcgacgcggtccccgccatccgggtgatcaagcccaagacctcggaggccatgcgccagctgatgcgcatggtggtcaccgacggtaccggcaagaaggccgacgttcccggctacgaggtgggcggcaagaccggcaccgccgaaaaggtcggcaacggcggctatcgcaagaaggcggtgctgtcctcgttcatcgccgccttccccatggatgcgccgcgctatgccgtgctgatgatgatcgacgagccccagggcaccaagcagacctacggcttcatcaccgccggctggaccgcggccccggccgccgggcgggtgatcgcccagatcgcgccgctgctggggctgatgcccaagaccctgccgattcccccgtccaccttgcccaagggaatcgcccgcaccggaggaggccgtgaagttgcggcggttgagtgacatgacggcgacagcgcccgcccgcgatgtgaccatcaccggcctgaccgccgattcccgcgcggtcaggccgggctatctttttgccgccctgcccggaaccaaggccgacgggcgggcgttcatccccgccgcgctcgccgccggcgccgtggccgtgctggcccccgagggctcgcgccccgacctgccgcccgaggtggtgctagtcaccgatgccaatccccgccgccgcttcgccctgatggcctcggccttccacggcgcccagccccgggtgatgaccgccgtcaccggcaccaacggcaagacctccaccgccgagttcttccgccagatcatggcccgcctgggccacgccgccgccgccatcggcaccctgggcatcaccgcgccgggctgggacaaccagggcggactgaccacccccgaccccgccgggctgcacgccgatctcgcccggctggccgaaatgggcgtcacccatgcctgcatggaggcgtccagccacggcctggaccagcaccgcctggacggcgtccggctgatggccgccgccttcaccaacctgacccgcgatcatctcgactaccacgccgacatgaacgcctatgccgaggccaagctgcggctgttcgccgaagtgctgcccgagggcgccaccgcggtgatcaacgccgattccgatctggcgccccgcgccgtcgagctgtgcgccaaacgcggcatcaccgtgctgggcttcggccggaccgcccgcgacctgcggctgatcgaagcccggcccaccgccgccggccaggagttggacctggagatcatgggccgcgccgtgaccatccgcctgccgctggccggacgcttccaggccgacaacgccctggccgccctggggctggccctggcctgcggcgccgacccggtggcggcactcgaggcgctgggacacctggacggcgtgcccggccgcctgcagcaggtggccagccgcgccaacggcgccccgatctatgtggattacgcccacacccccgacgcgctggagacggtgctgaaggccctgcgtccccatgccgcccgccgtctggtggcggtgttcggctgcggcggcgatcgcgatgccggcaagcgccccctgatgggcgccatcggctgccgtctggccgacgccatgatcgtcaccgacgacaacccccgctcggaagacccggccgccatccgcgccgccgtgcgcggcgcctgccccgccggcatcgagatcgccgaccgccgcggcgccatccgcgccgccgtgtcgggcctgcagaagggcgacgtcctggtcatcgccggcaagggccacgagcagggccagatcgtcggcgcctccgtgctgcccttcgacgatgccgccgaagcccgcgacgccgtccgtctcgccgatggagacgcctcatgatccgcccgctgtggacctcggccgaagtggccgccgccgtggccggcaccccgtcgggcgccgcctgggaagcccagggcgtgtccatcgacagccgcagcatcgaacccggcgacctgttcatcgcgctggaaggccccaaccacgacggccacgaccatgtggcctcggccctagccaatggcgccgccgccgccctggtgcacaagctgccccggggcacggccgaggacgcgccgctggtgctggtcaaggacaccatgacggcgctgcaggaccttggcattgcgtcccgcgcccgcagcaccgcccgcatcgtggcggtcaccggcagcgtgggcaagaccggcaccaaggagatgctggccctggccctgtccgaccagggcgccacccattacagcgttggcagcttcaacaatcactggggcgtaccgctgtcgctcgcccgcatgcccaccgccgtgcaatacgccatcttcgagatcggcatgaaccatcccggcgagatcaccccgctggtccgcatggtgcgcccgcatgtggcggtgatcaccaccgtcgagatggtgcacatggagttcttcgcctccaccgccgagatcgccgcggccaaggccgagatcttcgacggggtcgagacagggggcaccgccgtgctgccccgcgacaacgcccatttcgcctacctgaatgacgccgcccgcacggccggactcaaggatatccgcagcttcggcaaccacatcgaagccaccgcccgcctgctggactgcgccgtcgacccccagtccaccgcggtcttcgccctggtggccgaccagccgctgtcctaccgcgtcggcgtggccgggcggcaatgggccatgaactccctggccgtgctgctggcggtcgaggccctgggcgccgacgtcaatctggccgccatggccctggccgccatggcggctcccaaggggcgcggccagcgccgccggatcgagatcgaaggcggcagtttcgagctgatcgacgaaagctacaacgcctcgccggtgtccatgaaggcggctatcgccatgctggcctcggtgcggcccgccaagggcggacggcgcatcgccgtgctgggcgacatgctggagctgggcccccagggtccgtccttgcatgcctcggtggccgagacggtggaaagctggaacatcgatctggtgttcaccgccgggacgctgaccgcccacctgcacgacgccctggccgcgccgcgccggggcggccacgccgccgattccgacgcggtcgccgccctggtcaaggcaggggtccgccccggcgacgtggtgatggtcaagggttcggcgggcagccggatgggacgcgtggtcaatgctctggccgaagggggccgctcgaatgctgtataatctcctctaccccctggccgaccaggtgccgctgttcaacctgttcaaatacctgaccttccgcacgggcggcgcggtgctgaccgcgctgatcgtcgccttcctggtgggaccgcgcatcatcgcctggctgcgccagtggcagaagcaaggccagcccatccgcgccgacggcccggaatcgcaccttctgaccaagaagggcacgcccaccatgggcggcttcatgatcctgctggccctgtcggtctccactctgctgtgggccgatctgcgcaaccagtatgtgtggatcgtcctgctggtcaccctgggctacgggttgatcggcttttgggacgactacctgaaggtttccaagaagaaccccaagggcgtgccgggcaaggccaagctggtggccgagatcgccatcgccctggccgccgccgcctgggtctggagcctgcagcgcgagcccctggccggcgccctggcggtgccgttcttcaagaccgtgctgctccagctgtcgtggttctacctgcccttcgccgtgttcatcatcgtcggcgccggcaatgcggtgaatctcaccgacggcctggacggcctggccatcgtgccggtaatgatcgcgtcgggcgtcttcgccatcttctcctatctggtcggccacgccgtcttcgccaattacctgcagatccactacgtctccggctcgggcgagctggcggtgttctgcggcgccctggtgggagcgggcctgggcttcctgtggttcaacgccccgccggccatggtgttcatgggcgacaccggcagcttggctctcgggggggccctgggcgcgatatccgtcgtgacgaaacacgaactggtgctgggcatcgtcggcggcctgttcgtgctggaaaccgtctcggtgatcgtccaggtggcctcgttcaagctgaccggcaagcgcgtcttccgcatggcgccgctgcaccatcacttcgagaagaagggctgggccgagccgaccgtggtcatccgcttctggatcatcgccaccatcctggccctggccgggctggccaccctgaagctgcgctgaggtatcccggtcatgatctccgttcccctcctcaaaggtaagcgcgttctggtgatgggcctgggcaagtccgggaccgccaccgcccgcgccctgctggcggcgggagcgggcgtgatggcctgggacgacggcgaggctgcgcgcaagtccggcgccgaagccggcattcccatccgcgaccccagcctcctgccgctggacaaggccgacctgctggtgtggagcccgggcatcccccacacccacccccagccccatcccctggccgaaaaggcccgcgccgccaacctgcccatggtctgcgacgtggagctgctggcccaggccttgccgggcgcgcgcatgctggcggtgaccggcaccaacggcaagtccaccaccaccaccctgttggcccatgtgctggacgagtgcgggctgcccgtggccgccggcggcaatctgggcaccgccgccctggacctgcccgaactgccgggcgacgggcgctatgtgctggagctgtcgtcgtatcagttggagctgacccacagcctgaaactgggcgtcgccatcctgctcaacgtcacccccgaccatctggggcgccacggcggcatggcgggctacatcgccgccaagcgccgggtgttcgacttcctgacccccggcggcgcggcggtggtcggcatcgacgacggcccctgccgcgccatcgtggccgagctggatcgtcgcggcatccgggtggtcaagatctccgtggattccgtgctggccgagggcgtttccgcccccgagggcgtgctgctggacaacgcaaagccggtctgcgacctgaagaccatccccagcctgcccggccgccacaactggcagaacgcctgcgccgtctatgccgccgcccgcgccgagggcctgtcgcccaagcagatcgcccaggcccttgccacctatcccggcctggcccatcgccaggagctggtgggcgaggatcacggcatcgcctggatcaacgattccaaggccaccaacgccgacgcggtggaaaaggccctggtctgctacgaccacgtctactggatcctcggcggccaggccaaggaaggcggcatcgcctccctggaaaagcatttcggccgcatccagcacgccttcctgatcggcgaggccaccgaagccttcgccgccaccctggacggcaaggtgcgcttcacccgctgcgccaccctggacaaggcggtggccgccgcccgcaatctggcggtgtccgattccattcccggcgcggtggtgctgctgtcgccggcctgcgcctcgtgggaccagttcacatcgttcgagcatcgcggcgacaccttccgcgagctggtccaggccttcgaccagggaggcgcggcatgagcgtcaccttcgggcgtaccgatacctccgtcctgggccgctggtggtggacggtggaccgctggaccatcgcggcgctgttcctgctggtggcggtcggcgccatcctgaccatggccgccagcccggcggtggccgagcgcatcggggcgcaaagcttccacttcgtgcgccgccagttcatgttcctggcgcccgccatcatcatcatgctgggcgtgtcgctgctggcgccgaagcaggtgcgccgcatggcggtgatcggcctgctgggctccatcctgctgctggccgtggtgccggtgctgggcggcgagatcaagggcgccaagcgctggctcaatctggccggcatctccatccagccgtcggaattcgtcaagcccatgttcgccgtggtctcggcctggatgttcgcctcggcccgcctggaccccgccttccccggccggatcatcgccaccgccctgttcggactggtggccgccctgctgctgattcagcccgatgtcggccagaccgccatcctgaccgccatctggggcacccagttcttcctggccgggctgccgctgatcctggtggtggggctggggctggcggcacccatcggcatcgtcggcgcctattacgtcttcccccacgtccaggcccgcttcgacaagttcctcgatccgtcgggcagcggcgcctatcaggtcaccaccgcgctgaacgccttcaagaacggcggcctgttcggcaagggccccggcgaaggccgcgtcaagctggtgctgcccgacgcccacaccgacttcatcctggcggtgggcggcgaggaattcggcgtgctgatgtgcctgttcgtggtgatgctgttcgccttcatcgtgctgcgcggcttttcgcgcatccacaaggacgacaatctgttcgtggtgctggccaccgccggcctgctggtccagttcggccttcaggccatcgtcaacatggcctcgaccctgcgcatgatgccggccaagggcatgaccctgccgttcatctcctatggcggctcgtccatggtggcgctggcgctgggcatgggcatggtgctggccctgacccgcacccgctatggcagggagggcatggaggcatgagcacccaaaagcccctcatcgctctcgccgccggcggcaccggcggccacgtcttccccgccgaggccctggcctcggtgctgctggatcgcggctaccggctggccctgatcaccgacaagcgcggcgccgcctatggcggcacgctgggcaagctggaaaccttccgcatctcggcgggcggcatcgccgggcgcggcaagctgtcggccctgcgctccgccctggaactgggtctcggcctgatccaggcgcgatccatcctcggacgcatccgtccggcggcggtgatcggctttggcggctatgcctcggtgccgggcatgggggcggctgccctggccggcattcccaccgccatccacgagcagaacgccgtgctgggccgcgccaaccgcctgctggccgggcatgtgcggcgcatcgccacctccttcgccgaagtcagccacgtggagcccaagctggcgccgaagctggtccataccggcatgccggtgcgcgccgccatcctggccagccgcgacgccagctatgcggggatcaccgccgagggtcccatcgaattgctggtgttgggcggcagccagggggcgcgcatcctgtccgaagtgatcccggcggcgctggcccggctgcccgaagccctgcgcacccgcatccgcatcgcccagcaatgccgccccgaggacctggagggcgtgcgccgggcctatgacggcaccggcatcgacgccaccctggacagtttcttcgccgacgtgcccgagcggctggcccgcgcccatctggtcatcgcccgggcgggcgcctccaccgtggccgagctgaccacgctgggccgtccggccatcctggtgccctatcccttcgccgtcgacgaccatcagaccgccaatgcccacgccgccgaggattgcggcggcgcctggctgatgcagcaggattccttcaccgccgattccctggcggcgcgcctggactccctgttcacccaccccgaagccctggtgcgcaccgccgtctgcgcccgcaacgtgggccgccccgacgcggccgaagccctggccgacctggtggtcgggctgatccccaatgagagtggagcctgacccatgcgcaccatgtcgctgaacatcggcaccatccacttcgtcggcatcggcggcatcggcatgtcgggcatcgccgagatcctccataacctgggctattcggtccagggcaccgacatcgccgacaattacaacgtcgagcgcctgcgcaagatgggcatccgcgtccatatcggccacgcggccgaggcgctgggcgatgcccgcgtggtggtggtgtcctcggcggtcaaggccgacaatccggaagtccaggcggcccgcgccaagctggtgccggtggtgcgccgcgccgagatgctggccgagctgatgcgcctcaaatcggccatcgccatcggcggcacccacggcaagaccaccaccacctcgctgatcgccgccctgctcgataccgcgcggctggaccccacggtaatcaacggcggcatcatcaacgcctacggcaccaatgcccgcctgggcgccagcgagtggatggtggtggaagccgacgaatccgacggctcgttcatcaagctgccctccaccgccgtggtggtgaccaatatcgaccccgagcacatggatcattacggcacggtggagcgcctgcacgaggccttccgcaccttcgtcgagaacattccgttctacggcttcgccgccatgtgcatcgaccaccccgaggtccaggccctggtggcccgcgtgcccgaccgcaagctggtgacctatggcttcaaccatcaggccctggtgcgggtcgagaagctttccatggacatcaccggcgcccgctacgacgtggtcatcaccgaccgtgtcaccggcgccacccggaccatcgccgacatccacctgcccatgtacggcgagcacaacgtgctgaactccctggccgccatcgcggtggccaacgagctgggcctgcccaacgacgtggtcaagacggcgctgggcggcttcaagggcgtcaagcgccgcttcacccgcaccggcgaggccaagggcgtcaccgtcatcgacgattacggccaccatccggtggagatcgccgccgtgctgaaggcggcccgctccgcctgccagggcaacgtcatcgccgtggtccagccccaccgctattcgcggctctccagcctgttcgccgagttctgcacctgcttcaacgacgccgacatggtgatcgtcgccgacgtctacgcggcgggcgagaagcccatggagggcttcgacaaggccgccctggtcaagggcctgcaggagcacggccatcgccgcgtcatggccctggccgattccaaggccctggcgcccctggtcaattccctggccggtcccggcgacatggtggtctgcctgggcgccggcaacatcaccagctgggcccacgctttgcccgccgatctggcggccctgcccgacccctcgccggggggcgcggaatgatgacggcacgcaaggactccgactggcgcgacatgctgccccgggtgcaggggcggatgagtttcgacgcccccatggcgcccttcacctggttccgggtgggcggcaatgccgaggcgctgttccgtcccgccgacctggacgacctgatcgccgtgctggaggttctgcctccgcaagtgccggtcaccgtggtcggcgtcggctccaacctgctggtcagggacggcggcgttcccggcatggtcatccgtctcgccggtcccttcgccaccatcgacgtgatgggcgacaccatcaccgccggagcgggcgccctggacctcaccgtggcccgcaccgccgaggaggccgggctggccgggctggaattcctgtcgggcgtgccgggcaccatcggcggggcgctgcggatgaatgccggcgccttcggggccgagatgaaggacgtcaccgtctcggcccaggccctggaccgcgccggcaatctgcagatcctcggccccgaggaactgggcttttcctatcgccgctcggcggtgcccgagggctggatcttcctgtcggcctccctgaaggggcgtccgggcaaaccggccgatatcggcgcgcgcatggccgagatcgcccgggtcagggaagagtcccagccggtcaaggtgcgcaccggcggctccaccttcgccaacccggaaggccacagcgcctggaagctgatcgacgcggcgggttgccgcgggctggtcatgggcggcgcccaggtcagcgagaagcactgcaacttccttttgaacaccggcgacgccaccgccgccgacatcgaggatttgggcgaggaagtccgccgccgggtcctggagaccagcggcatcgacctgcattgggaaatccgccgtatcggcatcaggagggatgcgtcatgagcgctcgcaccgccctctctgcccgtcaccccgagcggatgcgaggggtctccgtctgctcggtccataccaacgtccccgcgccgcgccaggatgggatccttcgctgcgctcaggatgacagccttacgggagcctcctcatgagcaagcgcgtcaccgtcctgatggggggagcctcggccgagcgcgacgtgtccttgcgctcgggcgccgccgccgccaaggcgctggagcaggcgggcttcgaggtcgccctggtggattgcgaccgcaacccggccgagctggtgcgcgccatcaccgagaccaggcccgacgtggtgttcaatgccctgcacggccgcttcggcgaggacggctgcgtccagggcgtgctgaacctgctgggcgtgccctatacccattccggcctgctggcctcggcggcggccatggacaaggccttcgcccgcgccctgttcgccagtgccggcattccggtggccgagggccgggtcatcacgcggactgaccgtaacggccccgatcccctgccccgtcccttcgtggtcaagcccctgaacgagggctcgtccgtcggcgtgttcatcgtgcgcgacaaccagccgtcgccgctgcccgactggcccttcgacgccgacgaggtgctggtggaaagcttcattccggggcgcgagctgaccgccgccgtgatgggcgaccgggcgctgggcgtgctggaaatcacctcggaccacggcttctacgattacgaagccaagtatgctcccggcgggtcgcggcacctcatgcccgccccgatccccgaggccgattacgccgaggcctgccgcttggccgtggccgcccacaaggccctgggctgccgcggcgtttcccgcgccgatctgcgctacgacgacaccgttccgggccagccgccccggctggtcatgctggaggtcaacacccagcccggcatgaccgccacctcgctggtccccgagatggccgcctatcaggggatcaccttccccgagctggtgcggtggatggtggaggaggcgcgatgcgactgaaccccagcgacatcgtcatcaccgccgacgaccgtccgggcattcaccgggcgccgcgccagatctcggccaagcgccagacggtggaggccccggccgcccgccccaaggccaagcgccgctggccccgcctgcgcctggacatgagcccgctgcagcggctgaccggatacgggctggcggccacaatcctgctgatcggcggcctggccctgtggcattcgggcaagccgcagcgtctggtgcgcgagaccgccacggccttcctgaactccaccgccgaagcggggttccaggtggccgacatcaccgtctcgggacgtcgccgcacgcccaccgaccagttggtttcggccctgggcgcccagtacggcgatcccattctcggcctggacatcgccgccgcccgggcgcgcatcgaggcgctgcccagcgtgcgcgccgccgccatcgagcgccgcctgcccggcgccatccacctgtccatcgtcgagcgccagccggtggccctgtggcagaccgacagccgcttcgtgctggtggaccgcgacggccacaacattcccggcgccatcgagggcttcgaggacctgcccctggtggtcggcgacggcgccccggcccgcaccgacgagctgttcgccctgctggccaccgagccggaactggcctcgcgggtcaaggccgccatccgggtgagcaaccgccgctggaacatcaagctggacgacgtggaaaagggtctggaggcccgcctgcccgagctggacacccaggtcgcctggcaccgtctggccgaactggaaaagacccgcgccctgtcgggcaagcagatcaccatgatcgaccttcgggttcccgaccgtctggttctgaaaagcgagcgcgagccggtggtcaacaccgcctcggcggctcccccggcgcgggagcgctgatcatggcggcgcgcaacggcctcatcgcggcgttggacgtgggcaccaccaaggtgtgctgcttcatcgccaagatccaagacgacggcagcccccgcatggtgggcatcggccatcaggtggcgcgcggcatgcgcaacggcaccgtggtcgacatggaggagctggaaacctccatccgcgccgccgtcgaggccgccgaggaaatggccaacgatcaggtgcgcgccgtggccatcaacatctcgggcggccatcccggttcggccaacgtcaaggtcgaggtggccatgaacggccacgccgtcaacgaggccgacatccgccgcatgctcgaacacggccgcgcccatcacgaaagccccgaccgcgagctgatccacgccattcccgtggactacaccatcgacggcaacgaggggatcaaggacccgcgcggcatgttcggcgaccgcctgggggtcgccattcacgtcatcgcggcggggatcggcccggtgcgcaacctgtcgaccgtggtcaaccgctgccatctggacatcgaggcccgggtggtcagcccctatgcctccggcctcgcctgcctggtggaggacgagaaggaactgggcgtcacctgcatcgacatgggcggcggcaccacctccatcgcggtgttcctgggcggccagctggtccacaccgacgtcatcgccgtgggcggcgcccatgtcaccagcgatatcgcccgcggcctgtccaccccggtggtccatgccgagcggctgaagaccctctacggctcggtgatcccctcggcgtcggacgatcgcgagatcttcaaggtgccgctggtgggcgaggacgaggacggcgcctccaatcaggttcagcggagcatgctgatccagatcatccagccccggctggaagagaccttcgaactggtgcgctcgcatctggagcagagcggcttcgacaagctggccgggcgccgcgtggtgctgaccggcggcgccagccagatgcagggcgcccgcgatctggccggtcaggttctggacaagcaggtgcgcctgggcaagcccatcgggctgcacggcctgcccgaggccaccggcggccccgccttttccacctgtgccggattgatccgctacgccctggtccacgcccccgctccgtcgcggggcaagcggacgggcgccggcggcgacggagcgtcgggctggggccgtctcggctcgtggctcaaacggaatttctaagcttaaaccgggccgacaacgaatcggccacacagcgcggaggacctggatatgctgacttttctccccggggctcaccaagagctcaagcctcgaatcaccgtggtgggtgtgggtggcgccggcggcaatgccgtcaacaacatgatcctgtcgcggcttgaaggcgtcgagttcatcgtcgccaacaccgactcccagtccctgggccaaagccgcaccgagcgccgcatccaactgggcaatcaggtcactcaagggttgggcgccgggtcccgtcccgatatcggccgcgccgccgccgaggaaagcctggaagagatcctgggccagatcggtggagccaacatggtattcatcaccgccggcatgggcggcggcaccggttcgggcgccgcgccggtcatcgccagggccgcgcgcgagcagggcatcctgaccgtcggcgtggtgaccaagcccttccacttcgaaggcgcgcaccgcatgcgcaccgccgagggcgccatcgaggaactgcagcagttcgtcgacaccctgatcatcatccccaaccagaacctgttccgcgtcgccaccgagcgcaccaccttcgccgacgccttcaagatggccgacgacgtgctgtattctggcgtgcgcggcgtcaccgacctgatgatcatgcccggcctgatcaacctggacttcgccgacatccgcaccgtgatgagcgagatgggcaaggccatgatgggcaccggcgaggccgagggcgacaagcgcgccatcgacgccgccgaggccgctatctccaacccgctgctggacgacacctccatgaagggcgcgcgcggcgtgctcatcaacatcaccggcggcatggacatgaccctgttcgaggtggacgaggccgccaaccgcatccgcgacgaggtcgaccccgacgccaacatcatcttcggctccactttcgacgagaagctgaacggcaagatgcgcgtctccgtggtcgccaccggcatcgcctcggaagccgcggcgcagcccaagcccaccgtcatctcgctggtgacgccggccgcccagcccgccgccccggccccggccccggccgcccgtccggccgccgccgccgtccaggcgcccatcttccggccccagaccgcggcccagcccgccgtggccgccagcaccatctcggcccccgccgccgccgtggcccacgcccaccagccggtccatcgcccggcggtggccgcccaggtccagccggaactggacatcggccgtcccgagcccatggcccggcacgagcccatgatgcgggccgaacccatggtccgcaccgaggccctggcccgcgccgaagcccggcccgagccggaactgcgcctggatgccgagatgcgcgccgagcccggaatggactcccgccacgagccggtcctgggtcgcgcccaggcggacatgcgctcccagcacgagatgaaggatctgcacaaggcgctgtccgacatctccgaggccccggccgcgcccgtcctggcgccccagccgccccaggaaacccgccgcatgggcggtctgctcgaccgtctggtcaaccgccatcgcgccccggcccagccggcgccccagccccagccggccccccagccgcgcatggaagcccggcgcgagcccaccgccagccgggcgggcgaggacctggacattccggccttcttgcgccgccaggccaactgaggtcactgatgccgaaggggggctaagctcctcttccaacgcgctgtaagacttgggcccgaccggcttgccggccgggccccattttttgtttcacccgttgcaaatcaatggattggcactttgtttcacgacctggggtcagtgtaacatttggcaataatgattgatttgagccctggacgccggaggggtacacctttcaccatcaggttcaaggatcgcaaggcgccatacgacaccagcggcgcggcggcccaggagacaggggtttttagcgtgaatcagatcgtcagccatctgcgtcccgaagccaagtcctccacctcccattccatgcgtcagcgcaccttgaagagcgccatcggctgcaccggcgtcggcctgcattccggcgccaaggtgaccatggtgctgcacccggccgaggccggcaccggcatccgcttccgccgcgtcgacatcgccggcggcggcgccatcgtcccggccctgtggtcgtcggtgggcgacacccgcatgaacacctgcctgaagaacgaggcgggcgtggtggtcggcaccgtcgagcacctgatgagcgccctggccggcatgcagatcgataattgcctgatcgagatcaacggcccggaagtgccggtgatggacggctcggccgcccccttcctgtttctgatcgaatgcgccggcgtggtcgagcaggaggctccccgtcaggccatcaagatcctcaagcgcgtcgccatcaaggacggcgagcgtaccgcctcgctgaccccgtcctcggggttctcggtgcgcttcgagatcgatttcggtgcctcggccatctcgcgccaggaattcttcgtcaacctgacgcgcggcaccttcaaggcggaagtctcccgcgcccgcaccttcgggttcgagcaggaagtggccatgctgcgcgcccacggcctggcccgcggcggctcgctggacaacgccgtggtgatcgacagcaccggcaccaaggtgctcaatgatgacggcctgcgctatcaggacgaattcgtccgccacaaggttctggacgcggtgggcgacctctatctggccggcgccccgctgctcggccattaccacggcgtgcgcgccggccacgcggtcaccaaccagctgctgcgcgccctgttcgccgacgccaccgcctgggagctgaccaccatcgctcccggttcggccgccgcgccgttcgccgcccagcccctggccatcgccgccaacggctaatccggtttcgacccccaaatggccctctccgcttcggcggagagggtttttttacggccggaagctgctatagtgcggcgcgttttgcgtccattcctcataaagagcctccatgcgccatcgctccgccacctcccgtcttttgccggccctcgccctgtcggcggccctggccgccggattgggggcgtgcagcgagaagaagcccgaatatgtcgagcgcccggtggaggagctctacaacgaggccatggatctggtcgatgccaacgaatactacaaggccgcccagctgttcgacgaggtggaccgccagcacccctattcggtctgggccaccaaggcgcagttgatgagcgcctatgcgctgtacgagcgcaacaagtacgacgacgccatcgtggcgctggaccgcttcatccagctccatcccggcaacaagagcatcgcctacggctattacctcaagggcctgtgctattacgagcagatcaccgacgtcgcccgtgaccagaagctcaccgagcaggcgctgaagatcatgcaggaagtggtggaccgctttccctccacgccctacgcccgcgatgcccgcctgaagatcgaccttgcccgcgaccatctggccggcaaggaaatgaacatcggccgctattaccagcacctggaacaccatctggcggcgctgaaccgcttcaaggtggtggccgagcagtaccagaccaccacccacgtgcccgaggcgctgtatcgcatggtggagatctacaccgccctgggtctggaccaggaagcggcgcgggccgccgcggtgctgggccacaacttccccggcagcgactggtacgaggatgcctacgccatggtggagaagggcaatctcaaccctaccggccggtccaagaagcactggaccgatcccctggtcttctggtccaacgacaaggacaagcgtcaggagatcccgaaggccgacgaccccgccaagaccagcggcggctggttcaactgggccaagttctggtagatgctgaccgcgctcgcgatccgcgacgtcgtcctgatcgagcggcttgatctttccttcgacggcggcttgtcggtgttcaccggcgagaccggtgccggcaagtccattctgctggactcgctggggctcgccctgggggcgcgggccgaatccgggctggtccgccttggctcggcccaggcctcggtcaccgccgaattcgatccccccgccgctcaccccgcccgcgccctgctggccgagcaggacgtggacgccaaggacgggccgctgctgctgcgccgggtcctgaccgccgacgggcggtcgcgggcctatgtcaacgaccagccggtcagcgtcgggctgctgcgcaaggtgggcgacgaactggtggagattcacggccagttcgaaagccacggcctgctggattcctcgacccatctgggcgtgctggattccttcgccgcccaggccgaggccggctcggccctggccgccgcctggaccacctggcgcgacgccgccaaggcccgccagcaggccgaggccgatctggcccgggccaaggcggaagaggagcatctgcggcaggtgcacgaggatctgtcctccctggcccccaagccgggcgaggaagccgagctggccgccgcccgcgccgtgatgatgcatggcgaaaagctgctcgaagccatgaacgccgcccagtccgccctgattcaaaagggcgaggtggaagcctccctgcgctccgccgcccggcacctggagcgggtcgccgagaaggccgagggcaagctggacccggtgatcgccgccctggaccgcgccgcccaggaagccgccgaggccaccaacctgctggagcgcgcctcggccggcatcgacctcgacccccgccacctggaaaaggtggaggaacgcctgttcgcgctccgcgccgccgcccgcaagcatcaagtggccgtggacgaactgccgctgctgctcgaccgtctgggccgtcagctagccgccctggaaggcggcggcgacggcttggcccggctggcccgcgccgagcaggccgcccgcacccagtacctggagcaggcccgcgccctgtccaaggcccgcctggccgccgccgcccagctggacagggcggtggccgccgagctgccgcccctgaagctggacaaggcccgcttccagacccgcgtcgcgcaggtagacgaggcgcaatggggaccgagcggcctggatcaggtcagcttcgaggtcgccaccaatcccggctccgcccccggcccgctgggcaagatcgcctcgggcggcgagctgtcgcgcttcatgctggcgctgaaagtggtgctggcccgcatctcgtcgacgccctccatcgtcttcgacgaagtggattccggcatcggcggcgccgtggcggccgcggtgggcgaccgcctgggccgtctggccgaatccctgcagatcctggtggtcacccactcgccccaggtggccgcccgcggcgaccatcattaccgcgtggccaaggcggtttcaggtgataaaaccaccaccggcgtcgaccgcctctcccccgaggcgcggcgcgaggaagtggcccgcatgctgtcgggcgaaaccatcaccgaccacgccagagcggcggcggatgcgctgatgggcgccggatgattcccgtcgaggccctcacccctttcgaagcccgcatcgagcatgccgagctggtggagaccatcgcccgctgggacgaggcctatcacgccaaggatgcgcccgaggtacccgacgacgtctatgacggggccaagcggcgcctcgccagaatcgaggggcgctttcccgaactggcggccaagagccctatccgggacaaggtgggcgccgcgccgtccgaggggttcggcaagctggtgcacgccgtgcctatgctgtcgctggacaatgccttcgcccccgaggacgtggccgagttcgacgccaaggtgcggcgcttcctggggctgggcgacgaggcgccgctggcctatgtggccgagcccaagatcgacggattgtccatcaacctgcgctatgagggcggccggttcgtctcggccgccacccggggcgacggggcggagggcgaggacgtcacccgcaatctggaaacttttcccgcgacgcaattgccccgcaccctcggccccgacgcgccggcggtgatcgagattcggggcgaggtctacatgaccaaggccgacttcctggcgctgaaccagcggcaggaggcggcgggcgagaagctcttcgccaatccccgcaacgccgccgccggcagcttgcgccagttggaccccaaggtcaccgcgtcgcggccgctgtcgctgttcgcctatgccatgggcgaggcctccgccccgcccgccgccagccattgggaatacctggaacgcctgaaggcctggggcttcgtggtcaatccgctgatccgccgctgcgacggggtcgccggattgctgtccgcctatgaatccttgggcgaggcccgcgccacgctcgcctacgacatcgacggcatcgtctacaaggtggacgacatcgagttgcagcgccgcctgggcttcgtgtcgcgcagcccccgctgggccatcgcccataaattccccgccgagcaggccaccacgctgctggaggccatcgacatccaggtggggcgcaccggggcgctgacccccgtcgcccgcctgaccccggtcaatgtgggcggcgtggtggtcagcaacgccaccctgcacaacgaggacgagatcgcccgcaaggacgtgcgcatcggcgacaccgtcatcgtccagcgggccggcgacgtcatcccccagatcgtcggcgtggtgccgggcaagccgcgcggcgccgttcccttcgtctatcccgagacctgcccggtgtgcggcgcccatgcggtgcgccccgagggcgaggtgatccgccgctgtaccggcgggctgacctgcgaggcccaggccaaggagcgcctcaagcatttcgtgtcgcgcaacgccttcgacatcgagggcctgggcgagaagaacatcgagttcctatgggagaagggctgggtgcgcggcccggccgacatcttccgcctcaaggcccgcaacgacgcggaactgctgcagcggctggagaatttcgagggctggggcaagcgctccaccgagaagctgttcgagtccatcaagacccgctcggccatgggcctggagcgcttcatcttcgcgctgggcatccgccagatcggcgaggccaccgccaagcggctggcccggcattacggcagcttcggggcctggcgcgccgccatgctggccggcaccgaggaggcccgcgccgagctgaccagcatcgaggatatcggcccctcggtggcgggcgatctgctggacttcttctcagaagagcacaacgtccaggcggtggatgatctggtcgccgccatggccgccctggacggcgccgtcgaggacgccaaggtgatcgagtcctccgcctctcccgtggcgggcaaggcggtggtgttcaccggcaccctggtgaccatgacccggcccgaggccaaggcccgcgccgaagccctgggcgccaaggtggtgggctcggtctcgaagaagaccgattacgtggtggtgggggccgatgccgggtccaaggccgccgaggcggtcaagctgggcatagcgacgctgtctgagcaggaatggctggcgctgaccggcgcggcggactgacggcgggggcctcgttgcgtccctcggtgaagttgacgccggcgcggaacatcttgtccgccagatacccctgaacgaagggaatgcccatggcatgggcgaagtccagcgaccgctcgctgtcgcagcgggtcagcaccaccttgtccgggccgaattccttgatggcgcgaatggccacttccagatcgcggcgcggcatggtggtgatctgctcggaccacttgatcttggcgaattccgccacggcgggcaggcggaacacctgcagatcgctgagcgacaggccgtcgacgcacagagggacgttcaggtccgaggcccgccgcgtcagggcgtccagatcgccggaatgctgcaggaagtcgccacggtcgatttcggccaggatcttgcccgacagccgcgccggaacgccgtccatgaaggtctcgaactccttggacagcaggctggtgcccagcaggttgatggaaaaggccttgtggcggtactcgccgatctcgcggccgatgatccgcatcagccgcaggtccagttcggccttgatcatgtggaacaatgccggattgccggcgatgtcgtgttcggggcaagccgccttgcgcatctggtccagcgaggcgaagaactccaggtactcgatccccggcttcttgcccgcccagcgatagaccggctgattgaagaccatggcccggatatcgctgtcgcggatgatacggacgatggaatcgaattccttcattccgatggccgggcgggcggcggtgggagcgaccgccaccagcgccttgaccgaggtgatcagcttggccaggtcgcggccggcgtcgaacaccttgaaatacttgttctcgccataggaattggcccggggcggcttgtcgccgaagaacagggcctcgaggcgcgagcacacggtctggatcaccgccgccgaaacctgcgagcagatgaacaccatgtcccccgacgacagcaggaaacagccggaatccacggaattgaacagattgcgggacaccagatcgcggcccttggccagcttctcgccgtgcttgggatcgcccttggcccaggaggtgaagacatggatcacccgcttgccatagggcgagcggcgtatctgggcgatagccttcagcagatcctggtcgtcactcatgtcgcatcccacccctgtcgccgtgttgcggggtcagaccaccagcccctcccgcagggcgatggccgccaaggccaccggtgtcctcacccccaatttgttcatgatgttctcgcggtgccggtccaccgtcttgacactgattcccaggattcccgccaccttctggttggtgtagccctccgccagcagtttcagcacctgacgctcgcgccccgacagcggcgccacggcgctgccagccgccaggcctccctcttcgccgccatccaccaccagcccggccgatggcgagatatagcgccgcccggccatggcctcgccgatggcggtttccaggtcctgccagccgcccgtcttcaaggtgtaggcgtccacacccagggcaaaggcccgcttcatggtcgttccgtcctgggtcccggtcagaaccacgatccggctggcgggattgcgccgcttgaccaggggaatgatgtccatcccgtcaagccccggcatggaaaggtccagaatgatcaaatcgggcttggcgtcgtcgatcagatgcagcgcggccacgccgtcatccgcctcgccgaccacgtcgatccacgccatgccttccaaggcgcggcggatcgccgtccgcacaatcccgtgatcatccacaagtaccgtccgaaccgccccccgatcaccactcatcaccgccaccacactcgtgatcacccagtcccttggagaggatatcacggccgctcaaggcttttttcgagatctcggcatgacatactgtatatatatcgaacacaaaaggtatgccgtaagcattgccgccgccggtatcgacggccttcactatggcgaaccaacatggtgattcattagatcagactcggccaagcacgcaattgggagattcccccattcttcagtgaagagatcttgatattcattcacactccagtctccatgatacgtgttactacggtgtatcaaaaaaaatatgctgcggaatcaatgccggcgcccatgacacctgccattccacgccacatacaatgagggacggacagaccccttgtgcgacgcaacaacacgataaataaatccatttatattctgttcttaacctgaccaacgacacatcaagacccagtcttgcgacacttcggcgcagaaccaccggaaggcaccatgtccaagcacccgaaaccgccagagcagttgccgttgtcgccgctctcccgtatacggtgagacatggcggacgatcccaacgacagaagggcggaattgcagcgccgggcgcgtgacctcgcggccatgcgaggcgccgtggcgaagcccgcccaacccgagccggaagcggaggcgcaccctcccctggccgaggtggaggccaccgccaccgcggcggcggtcggcgccgaggcccggtcgtcgggcctgctggacctgctggtcagcctgttcaagcccaagcccacccagccgcaacgtccggtgcccgtcgccattcccgccgaggggccgtccttcaccatcctggtggcggcgctgtcgggcgatgccgacggtcaggcggccaccgccctcaatcaggcgctgagcgcccgcccggccttcaaggtcaaggccatcccgcgcctctaccagctggagcgcctggacgacccggcccaggtggcgggcgtctcgctcaacacccggcacgcagtggccgaggaggacgccgacctgctggtctggggcgagttcggcaaggacggctatcgcctgcgtctggccaccgccagcaatgacgacgagcgtgccgcctcgttcggcaccaccacccgcatcgaattgccggccgagttgggcgaagggccgtccaacctgctctacgccgcctgcctcgccgccgtggaggtgcccaccgaggcccaccgcaactccatccgccgcctgatgcccgccgccgccgcgcaggtggagagcctggccgccaagccgccggtgcagatgtccatgggacagcagcgctcgtgccagctggtgttcggccacgtggccaccatcaacgccatggtggtgccgcccgaggaaaccaacctgtggttcgacaaggccatcaacgcctatcgtcaggcccagcggcgcctcgcccgcaccgaccccacctgggagaccgggctgatccacaagcatatcggcgccgtgctctcggccaaggccgagcgctccaaggacccggcgccgctgctggaggaagccatcaaggaatggcgtcaggcggtggaatgcctgccgcgcgccctgatgccgcaggaatgggcctcggcccaggtgcggctcggcgtggcgctgtatcgcctcgacctcaagaccggccagacggaattgctgcgcgaatccgtgcaggcgctgcaggccacccttcaggtctattcccgcaccgagacgccccagcgctgggccgaggtgatgcacaacatcgcccaggtgctggaagtctatggcgaccagctgaaaagcaccgaggtgctgaagcgctccatcgacgcctgccactcggtgctggagatcagaacccgtgagcgcggccccctgtcctgggccgccacccagaacaccctgggctcggccctgttcctgctggatcgccactccaccggcgccggccacctggccgaggcggaagccgccctggccgccgcgctggaggtgttccagacccacggcgccaaaggcccggccaaggtggcggccaagaatctcggccatgtgcgcaagctggccgaaagccgcaagacccggcaggtgatcgagccccattggctcgacgatcccgacagcaagtagcttcccaaaacagctgtcgcacactatggtccggcagccccgacgcaagatgatcgcctttccatgaccaagctcagccatatccgcaatttctccatcgtcgcccatatcgaccacggcaagtcgacccttgccgatcgcctgatccaggcttgcggcgccatcgaggcgcgcgagatgaaggagcagatgctcgattccatggatatcgagcgcgagcgcggcatcaccatcaaggcccagaccgtgcggctggactacaaggccaaggacggcaagacctatcagctgaacctgatggacacccccggccacgtggacttcgcctacgaggtctcgcgctcgctggccgcctgcgaggggtcgctgctggtggtcgacgccagccagggcgtcgaggcccagaccctggccaatgtctatcacgccctggatgccggccatgaagtggtgccggtgctcaacaagatcgacctgcccgccgccgagcccgagcgcgtcaagcagcagatcgaggacgtcatcggcctggacacctcggacgccgtgatgatctcggccaagaccggcatcggcatcggcgacgtgctggaagccctggtcaaccgcctgccctgccccgaaggcgatgccgacgcgccgctgcaggccctgctggtggattcctggtacgacccctatctcggcgtcatcatcctggtgcgcatcaagaacggcgtgctgaagaagggccagaagatccgcatgatggcgacccaggccgcctatcaggtggattcctgcggctacttcacgcccaagctggtgcagaccaccgagctgcgccccggcgagatgggcttcttcaccgccgccatcaaggccgtcgccgacaccaaggtgggcgacaccgtcaccgacgacaagaagcccgccgacaccccgctgcccggcttcaagcccagcgtgccggtggtgtggtgcggcctgttccccatcgacgccgccgattacgaggatctgcgcgactcgctcgccaagctgcgcctcaacgacgccagcttccagtacgagcccgagacctcggccgccctgggcttcggcttccgctgcggcttcctcggccttctgcatctggagatcatccaggagcgcctggagcgcgagttcaacctggacctcatcaccaccgcgccgtcggtggtctatcgcgtccacaagaccaacggcgagatggaggaactccacaatcccgccgacatgcccgatccggcccgcatcgaccacatggaagagccgtggatcaaggccaccatcatggtgcccgacgaatatcttggccccgtcctgaccctgtgcaccgagcggcgcggccagcagatcgacctcacctatgccggctcgcgggccatggcggtgtacaagctgccgctcaacgaggtggtgttcgacttctacgaccgcctgaagtccatcagccggggctatgccagcttcgactacgaggtggattcctacgcccagtccgatctggtcaaggtctccatcctggtcaatgccgagccggtggatgccctgtccttcgtggtgcaccgcgccaacgccgaaagccgcggccgcggcatctgcacgcggctcaaggaactgatcccgcgccagatgttccagatcgccatccaggccgccatcggcgggcgcatcgtggcgcgcgaaagcatcagcgcgctgcgcaaggacgtgaccgccaaatgctatggcggcgacgccacgcgcaaacggaagcttctggagaagcagaaggaaggcaagaagcgcatgcgccagttcggcaaggtggaaattccccaaagcgccttcctggccgccctcaagatgggtgattcgtaaccctccaccgatagggaccggatgagcggcgcggcgcggacacaggccaggggcgatcggacggtcgaattccgcgccgaggaactggcctcgcgctttcccccgctgctggtcgaggccgagcgggtggcccaatcggtcgcccagggcgtccacggccgccgccgggccggatcgggcgatgccttctggcaataccgccgggctcagccgggcgacggggcgggcgccatcgactggcgccgttcggcccgttcggaccacctctatgtgcgcgagacggaatgggcggcgtcccaggccgtctggctgtggctggacggctcggcctccatgcactggcgctccgacaccggcctgcccaccaagcattcccgcgcccgcctgttgatcctggccctggcctccctgctgctgcgcggcggtgagcgggtggcggccctggccggagagatgccgcccctgtggggcagcggggcgctggcccgtctggccgagaccctggagcgggccggcgacgcccccgccgtcccgccgtcacgcctgccgcgtcatgccaccctggtgctggccggtgatttcctcgatccgctgcccgtcctcgccagccgcctggaggccctggcccggacgggggcaggcggtcatctgctgcagattctcgatcccgccgaggaaagcctgccctatgccggccgcctgcgctttctggggctggagggcgaaggcgagttggaaaccggccgggccgaagacctgcgccaggaataccagcggcggctggcggagcagcgcgacggcctcgccgccatggcccgcgccctgggatggagcttcgccacccaccgcaccgaccggccgcccgccccctgcctgctggccctggcccagagcgtgggagggttgggatgatccccttcaatgtcatcccgagcgcaggcgagggatctccgcctggaccgctggtgcccaacgggaaagactggatcagaacgagatccctcctcccgttggtcgtcgggatgacagcctcggggagtgcagccccatgacctttctgcccggcctggccttcgccgccccctgggcgctggcgctgctggccggtctgccgctgctgtggcggctgctgcgggtcacgccgccccggccacgcaaggtgccgtttcccgccctgaccctgctgctcggcctcgacaccgcccggcgacaggcggagagcacgccgttctggctgctggccctgcgtctgatgctggcctccctgctgatcctggccgccgccggacccagcctggagccgatcccggccggacggagcgacgggccgttgctggtggttctcgacgacggctgggcggcggcgcgcgactgggaccggcggcgcgagcatctggaccagatgctggccgccgccgagcgcgccggccgccccgtcctgctgctgcccaccgcgccccccgccgacggcggcccgctgacgccgggacggctggccagcgcgtccgaggcgcgggcccaggcggcgggcatggagccccgaccctggcccaccgaccgcaaggcggcgctggcggccctggaaaccctgcccttcgaccgggtggggcgcgtggtgtggatcagcgacgggctggccgatcccgccgacgaagccctgttccgtcggctgcaaggcctgggcggagggctggaggtggtgacgggccaaagcggccgcctgctgctgcctcccaaggacggcacctcctccgaacacatgatgccggtggtgcgccgcctgcccgcggccgagcccgaacccttcgccctgcgcgccctggatgcccgggggctggtgctggcccgcaccgaggggcgcttcgagcccggccgcgccagtgccgaagccttgctggacctgcccgtgggcctgcgcaaccgtctggcccgcctggagatcgagggcgagcgctcggccggggccaccctgctgctggacgagtccagccgccgccgctcggtgggcatggccggcggcgacccatccgccgcgccgctgctcgaccggctctattacgtggagcgggccctggccccccatgccgagctgaagcggggcgaagtggcggaactggccgccgatccgccctggacgtaatcatcctggccgatacccccctgccacccggccccaccgcccaaaagctggccagccgggtggagcagggcgccgtgctggtgcgcttcgccggtcccctgcaggtccaggccgcccagaccgatccgctgctgcccgtgcgcctgctggcgggagggcgcgctttgggcggcgtgttgtcctggaccacgcccatgcgccttgcccccttccccgaggcctcgcccttccacggtcttgccgtccccgaggatgtggaggtccgttcccaggtgctggccgagcccggcctcgacctcaacgcccgcacctgggccagcctgaccgacggcacgccgctggtcaccgccgagcgccgcggcaggggaatggtggtgctgatccacaccagcgccaacgccgagtggggcaatctggccctgtcgggcctgttcgtcgacatgctgcgccgtctggccgccctgtcccagggggctgcgggaccggcggccatgggcggccccctggcccccgccgaactcctggacggtctggggcggctggccccggccagcggcatcgccgcccccatggagcgcgacgccctggcctcgacccgcccccagccccgccatccgcccggcttctatggaccggccgagcggcgcgccgccttcaatctcggcccggccctcccccccgccaaccgcttcgtgccgccgtccggcgccgctgtcaccccggtgggcgaaagccggcccggcctggatctcggcccgcccctgttgctggcggcgctggttctcgccctggccgacatggccgccaccctggcgctgcggggcctgctgtggcgggtggcgctcctcgccctggcgctgtggccatcgggaccggcgcgggcggaaactttcgccctggaggccgggctggccacccgcctgggctgcgtcgccacccatgatgccggcatggaccgcctgtgcctggcgggtctgcgcggcctgtcggcccggctggcggaacgctccaccgccgaactggccgagcccatgctggtgaacccggagcgcgacccggtggtgttcttccccctgctgtactggcgggtcactcccaaccagccgcaaccctcggagcaggcggtggagaagctcaacgcctacatggccaaggggggcgtgatcgtgttcgacaccggcgacgaaggccaggcgggcgccggccccaacaccgccgagctggagcgtctgcgccgactggtggccggtctcgccctgccgcccctggcccccatgggggccgaccatgtgctgacccgctcgttctatctgttgaaaagcgtgccgggccgctgggacggcgccaccttgtgggtgagccagggcgccgaagcgggcaatgacggcgtctcgccagtggtggtgggcggcaacgactggatcgccgcctgggcggtggacgaacgcggacggcccctccatgccgtggtgccgggtggcgagcgccagcgggaactggcctatcgcttcggcatcaatctggtgatctatgccttcaccggcaattacaaagccgatcaggtccacctgccggccatcatggacaggttgaagcgatgagctttcatgccctcgccttcgcgccgctgttcccctggccgctgatcgccgccctcggcggaatggccgtgctgctggtgggcgtcggcctgtggcgcagggcgtcgggcacgttgttgcgcgccgtggtgatggccgtcctgctggcggccttggccaatccccggctgctggccgagaaccgcaccaccctgcccgacgtggcgctggtggtagtggacgagaccccctcccagggcatcggcgagcgccgcgcccagaccagggaggccctggacgagttgacccgccgcctcgccctgctgaaggggctggaggtgcgggtcgagcgggtgggggccgagcccggcgccgatcgcggcacccggctgttcgaggcggccgagcgcgccctggccgacgtgccgcgccgccggctggccggggtgacgctgatcaccgacggccgcgtccacgatgtgcccgccgatctcggccgctcgctgggcgcgcccgtccacaccctgctgaccggcgccccggacgagcgcgaccgccgtctggtgccgggcgcctcgcccgctttcgccctggtgggggagaccgccaccctggccttccgggtggaggaccagggcggcaagggcgatgccgtggtggcggtgcgactggacggcaagccccatgccgccatttccgtgcccctcaaccgcgacgccaccctggacgtgccgatccgccatgccggggccaatgtggtggagctggaggtggaaccgggaccgggcgagctgtccctggccaacaaccgcaccgccctgtccatctccggggtgcgcaatcgcctgaaggtgctgctggtgtcgggcgagccccatgcgggcgagcgcacctggcgcaacctgctgaagtccgacccggcggtggatctggtccacttcaccatcctgcggccgccggaaaaggacgaccagacccccatccgcgagatgagcctgatcagctttcccgtgcgcgagctgttcgaggaaaagcttgccgagttcgacctgatcatcttcgaccgctatcgccgccgcggcgtgctggcgccggcctattaccgcaatctcgcccgctatgtccgggacggcggcgccctgctggccgccgtgggaccggaattcgccgaagccgacggcatcgccgaatccgccctggccgaggtgctgcccgcgctgcccaccggtcgccgcctggacaaggagttccgcccgcgcctgaccgaggccgggcggcgccatccggtgatggcgggcctgccgggcacgcggccgggcgacgcgccctggggaagctggatgcgccagatggaggtgggaacggccaagggcaccaccttgctgtcggggctggacgaccggccgctggtggtgctggaccgggtgggcgagggccgggtggccatggtgctgtccgacaccctgtggctgtgggcgcggggctgggagggcggcggcccccatgccgagatgacccggcgtctggcccactggctgatgaaggagcccgacctggaggaaaacgcccttaccgccgcggtggagggcgggcgcctgatggtggcggcccgcggcgccccggacggggtggcggccaccatcaccgcccccgacgggacgcaggcgccgcttcgcctcgaccccgatgacgagggcgtggcgcgcggcgcgctggatgcgggccagaccggcctgtggcgggtcagcctgcccgatggccgcgtcgccctggccgccgccggacaggccgccccggtggaactggcggaactgaccgccacgcccgagcgccttttccccgtggccaaggccaccggcggcatcgtgtcctggctgtcccgggacggcctgcccgatccccgacgggtggcggcgggctcgaccaccggcggccggggctggatgggcttggccgagcgtggggactatgtggttgacggcattcgcgaaaccgccctggcccccgcgctggcgctggctttgctctgcctcggcgggctgctgatggtgtggcgaaatgaaacgcggtgatccactttttgccgtccatcggcagattcgatttggaatatcggccggaccgatgtaaggagttcttacctataggttaatggtggaggggctggttagactggccgccgctgaccgatgggcaggccgaccgaaacctgggggggacgtcaggacagtgaccgaacagcgactgatcccggcagccggcaagcggctcaaggcgttgcgtcgggcggcatcctggatgattcccgagtggcaggtcttcatccgccgccccaacggcaccgccgagcatttcaccttcacccgcaagcgccagatggttctgctgggcatcatggtggccgtcaccgcctgggccggcatcgtttcggccctgctgacccgtcagcccgacgagatcgccgccaaggaacgccagctcgaagagatgatggccgccacccgcgccgcgcagtaccgtctggtgtcgtcgcagaagatggtggccgacatcgcccgcgaggtggatctggtccattccaacgtggcggtgctggccgagaccaacgccgccctggccaaggaccagcccccgaagaaggtcagcccgccggccaagcgcaattccggcggcgccgagcccgcctggaacgaggacggccagccggccggcgacgaggcccgcgccgtgcgcgagcaggtccgccgcctggaaggctcgttggagcggctgcgcgtcgcctattcccaggcggtgcagaacaccgacgccgccgcccagtcgcgcatttccgacaccgagcggctgctgaaccggctgggcctggacgcgtcgcgcctgttcgagcgccagggccgcgatgccggccgtggcggcccgttcattccgctgaccacggtgaccggcgacaccggcttggccggactgatggaccgcctggaccgctggagcggcatcaaggcggtcatgcagaagatgccgctgggcgagccgctgcatgccgattacgacctcaattccggcttcggcacccgcaacgacccgctgaaccgccgcaccggcgtgcatgaaggcgtcgacctgggcgctccgcacggtacgcccatctacgccaccggcgacggcgtggtggaatcggccgggccgtccgacggttatggcctgaccgtcgacgtcaatcacggcaatggggttaccacccgctacgcccatatgtcgcgcatcaaggtcaaggaaggccagaaggtgacgcgctcgacggtggtcggcctgctgggcaacaccggacgctccaccggcccccatcttcattacgaggtccgcgtctcggacatcgccaaggatcccctcaaattcatcgcggcaggtgaaaatgctcccaaagcttggtaaggcccttggggcggtgtccgccgccgcccacggctcgcgccacaacggcaccaacgggctgcccctgtcggtgatcggcgccgatgtgcgcatcgtcggcaacatcttcacccagggcgagatgcagatcgacggccaggtggaaggcgacatcacctgccaccgcctgctggtgggcgagggcgcccgcatcaccggcgaagtcaccgccgagacggtgcaggtgcatggcgaactgaacggcaagatcaacgccggttcggtgaccatcgccaaatcggccaaggtcgtcggcgacgtgattcaggacagcctggagatcgaggccggcgcctccatggagggccgtctggtccgtcggacgggtgcggtcaaggcgctggagcacgacaagggcaacggcgcggccgagcccgacgggacgccgccgccggccaagcccgacatcaatcaggaagccgccggaacggcatgatcaccacctatcacgccaaggacggcgccgtgatcgtcggcggcgccgatggtgtgagccgcgatgccctgtggctggatctgctggacccctcggccgaggaaatcgccctggtggaggcccgcaccggccttgacctgccatcccgcgaccgcatggaagagatcgaggcgtcgtcgcgcctgtcgcgccacggcgacgccctgatgatgacggtgcccgtgctgaccggggccggcggttccgagccgcgcaacagcgccgtgaccttcatcctgagccagagcctgctggtgacgctgcgccacggcacgccgcgcgccatcgccaccttttcccaggacctgccccaggccagcccggccccggccaatggcggcgacgtcctgctgggtctggtggaggccatcgtcgaccgcatcgccgacgtgcttcaggatctgggcgccggactcgacgtcatttcgcaccgcatcttccatcagccgaccggcaaccatcaccgccgccgccgcgccggctcgcgggagatggaggcgctgctgcgcaccatcggccgcaccggcgacctgtcgggcaaggcgcgcgagaccctggtgggcctgaagcgggtcatcgccttcctgccccacggcgccggagccctgggcctgggcaacgcgcccgagcgcctgcggtccatcgaccaggatctccactccctggccgagtacaccgactttctgggcaacaagatcaactttctgctggacgccaccctggggctgatcggcatccagcagaatcaggtgatcaagctgttcaccatcatgtcggtgctgttcctgccccccaccctggtggccagttggtacggcatgaacttcaagatcattcccgaactgcaatgggaatggggctatgcctacgccatcgccctggcggtgctgtcggcggtggtgccctacctcttcttccgccgcaagggctgggtgtagctcacccagccttggccgcctgggccagcctggcctgctccggcggataggcgcttccctgccacagcagggaataggcgatctcctcgttgccgttctcgcacagctccagcacatcccggaacagcggctggaaggtggcggagcggtgggattgctcgtgctcggcgaagctcttccagaaggtgatgatcagggcttcgcgtccggccaggggcgaggtcaccgcctgtcccaccgtcgagccttcgttggagatctggcccgaattcagacagacgaagccaccgacgaagccggtttccgaatgccaggtcttgacgttctcgcacagcagcgcgacgcgctcctccagatcgtccacggtaaagcccggccgcagcaccacccggttgaccgtcaccacgccatcggaaggaaacccttggatcagcatcgacgcctcctatattcaactatgctgatattgtgattatccgccgccgttcaagcccccctcttgccgccgccgccatcctcgggaaagatggcgccatccgaggggaacgaccgcatgagcgcccatacacccgcaccgcaggcccagcaggctttcaccgccgccgcccaggcctggcgcgaatcccgaatggacgctgccgagcagggctttgccgccgccgccctgctggagcccggctggtcctcggcccatgccaatctgggcgccgtgttgcgtcgcctgggcaagtgcgaggcggcggtggccagctatcgccgcgccctgacggtgggcgccgaagacgccggcactttgtccaacatgggcaacgcgctgcgcgacctgggcctgctggaggagtccgaaaccgcccatcgccgggcggtggcgctggccccggacaattggggctaccgctacaatctggccctgctgctgcgcgaccgccgcctgcatggggaagcccgcgccatgatggcggaactggcggcgaccgaccccgagaatgccgagatccagtgggatctggccctggccgacctctatctcggcgattaccgaacgggctttgccggctatgaatggcggatcaagctggcccgcaatccggtccgcgaccatcccggaccgcgctggaccggcgacgatccgacgggccgcaccatcctgctgctggcggagcagggcttcggcgacgcgctgcaattcgcccgctacgtcccgctgctggccgccaggggagcccgggtggtgctggaatgcctgcccgagcaggccgagctgttcgccagcctgcgggacgtggcggcattggtggccaagggcgcgccgccgcccgtccatgattgctgggcaccgctggccagcctgccccatctgctgggcacggaattccacagcattccggccgaaatcccctacctgtccgcgccgccgcgccccaatctgcgcatggtgccgccgccgggccagaagctggcggtgggactggtctgggcgggcaagaccacgccgcgtgaccggtcatggcccctggagcagctgacgccgctgctgggcgacccgcgggccacgttctactcgctgcaactggggccacgcgccggggacctgaagagcaccggcctggaacgcctggtgcgcgacgccgcgccggcccttcaatccttcgccgacaccgcccatgtgatggaacatctggacctgatcatcaccatcgacacctcggtggcccatctggccggagccctgggccgaccggtctgggtgctgttgcgttatgtttccgattggcgttggcaggatgaaccgctaacgtctccgtggtatccgaccatgcggctgttccggcagcccgatccttcggacttcaagactccggtggccgagatggccgccgaactggcctctctcatcgacgaaagacactgatatgcgcatcgccaaggataccgtcgtcacgctcagctatcgcgtcaccgacgccgacggcaccatcgtcgatgagggcgccgagcccatcatctacctgcatggcggccatggcgggctgttcccccggctggaagaggccctggagggcaaggaagccggccacgagctgtgcgtcaagctgcagcccgaggacgccttcggcgaatacgacgccgagctggtcagcgtcgaggacgcctcgctgttccccgacaacgtggtggtgggcatgcagttcgagcgcgtcatggacggcaagcaggacgaggccatgctgttctcggtcaccgacgtcgccgacggcaaggtggtggtggacggcaaccatcccctggccggcatggccctgatcttcgactgcacggtgagcgagatccgcgccgcctcggccgaggagctggagcacggccacccgcactatcccggccatcaccaccactagaaaaaagtcatcccgagcggagccgagggatctcgtcccggcacaatggcgcagacggagattcctcggctccgcctcggaatgacagactggaatgattgactccctcccggtccggagtatgttcggggccccctttccagaccgtatcagcaggatttcgccatgagcttcgccgcccttgaaaagaccatcgacgccgcctgggaggcccgcgacggcatcaatctccagaccaagggcgaagtgcgcgacgccgtcgaggcggcgctggacgccctggattccggctcgctgcgggtcgccgccaagggcgacgacggcaagtgggtggtgaaccagtggctgaagaaggccgtgctgctgtccttccgcctgtccgacaacaaggtgatgggcgacggccccggcaccacctggttcgacaaggtccccaccaagttcgagggctgggacgattcccgcttccgcgccgccggtttccgcgccgtgccgggcgccgtggtgcgtcgctcggcctatatcgcgccgggcgtggtgctgatgcccagcttcgtcaacctgggcgcccatgtgggctcgggcaccatggtcgacacctgggccaccgtcgggtcctgcgcccagatcggcaagaacgtgcacatctcgggcggcgccggcatcggcggcgtgctcgagccgctgcaggccggaccggtgatcatcgaggacaattgcttcatcggcgcccgggccgaggtggccgagggcgtcatcgtcgagaccggcgccgtgctgtccatgggcgtctatatcggcgcctccaccaagatcgtcgaccgcgagaccggcgagatcttcatgggtcgcgtgccggcctattccgtggtggtgtcgggcaccatgccgggcaagcccttccccgacggcacccccggccccggcctctattgcgccgtcatcgtcaagcgcgtggacgagcgcacccggtccaaggtgggcatcaacgagctgttgcgcgactgatgagctttcgcgatcccgtcccgctggcccaggccctgatccgctgtcccagcgtcaccccggaggacgcgggggcgctggacgtgctggccggggcgctggaggagctgggctttgcctgccaccacatccgctcggcgaccggcggaccggagatccggaacctctatgcccgcctgggcaccgaggcgcccaacctctgcttcgccggccacaccgacgtggtgccgcccggcaagggctggacggtggagcccttcgccgccggcatcgaccagggacggctgttcgggcggggcagcgccgacatgaagggcgccatcgcctgcttcgtggccgccgtggcgcggctgctggaggacggcgcccccaagggctccctctcgctgctgatcaccggcgacgaggaaggccctgcggtggatggcaccgtcaaggtgctggactggctggcggcgcgcggtgaacgcatcgattgctgcatcgtcggcgagcccaccaatccccgcaagctgggcgacatgatgaagatcggccggcgcggcagcctcaattgccgcctgaccgtgttcggaacccaaggacattcggcctatccccatctggccgacaatcccattccccggctgctggacatcctgcgccggttgaccgaggcgccgctggacgagggcacgccccacttccaggcctcgaccctggcgctgaccacggtggacgtgggcaaccccgccaccaacgtcattcccgccgaggcccgcgccggcttcaacatccgcttcaacgacctgcattccggcgcctcgctggaacgctggatcagggataccgtcgcccaggccggcggcgaggtggagatcaaggtcgaggtgtcgggggaatccttcctgacgccgcccggcgcgctgtcggacgccctggccgaggcggccttcgaggtgacgggacttcggcccgaactgtccacctcgggcggcacctccgatgcccgcttcatcaagaaccactgcccggtggtggaattcggactggtcggccagaccatgcacaagtcggacgagcatgtttccgtcgccgacatggaagcgctgaccgagatctaccgccgcgtcctcgtccggctggcggcgccgtcatgatcaccgccggcgagatcatcgccggagtcttcggcgcctggcggctggcccggcgcgatcccaccggactgatctggttcgacaccagcccgcgcggcttcgtgaattccttttggggaccggcgctgatcctgccgggcttcctggtgctgcaggctctggacggcaccttcgaggccgatctggcccggccgctggcggtggaactgatcgcctatgtcatcggctgcgtcgcctttcccctggccatgagtcacatctcggaaggcctggaacgctcgcacctctacatccgctacatcgtcgcctacaactggtcccaggtgatccagatggcggtgctgctgccggtcgggctgctgatccatctggcgcccggtcacggcatggccatgctcaacatggccgtgaccatcgtcgtgctggtctatcaggcctatgtcgcccatcaggccctggacgtgaagcccggctccgccggattgctggtcctgctcgacctctcgctgggcgccctgatccagatggtcgccaaccggctgatgggcgcctagacccgatggaatggcgggctgccgcccgcacccgcccggggcgatgccccggcccccctttgtttttatgaataaataaaaaagaggtttggagacttgttctccaagcggggtcggggcggcagccccgcttggcccggatcaacaggcccgatgcctgaaaaggaaaacgggccgcatcccggcggatgcggcccgttccctcgatacgcttgggacgaattacttcgcggcggcgatggcggcgtcgtaattgggctcctgggcgatctcggggaccaactcggcataggccaccttgccgcccttgatcaccaccacggcgcgggccagcagaccggccagggggccgtcgacgatcttgacgccatagcgctcgccgaagcccttgtcgcgcatgtcggacagggactggacccgctccaggccctcggcgccgcagaagcgcttgtgggcgaagggcaggtcggcggaaacgcacagcacggcgacgctgcccagcttgtccagctcggcattgaagcggcgcaccgaggcggcgcagaccggcgtgtcgatgctggggaaaatgttcagaaccacggtcttgcccgccacggaatccaggccgatatcggccagatcgacggtggtcagcgagaaggcgggggcagcggccccgaccgccggcaaggtgccgttggtgttgatgggattgcccttgagggtgatggcggccatggcggaacctctgatcttgttattggaagggctcgactttgccccaggtgcacccatcaggcaaccggtcgtcgagcggcgacctgagaaatttcagcggcgcttgatggcgccccacaccagcagcagggtgatgggcggcgcgcagatcagcaaaactcgatccagcgccacggcgaagccccagcgctcgccgttcagcaacagcgcctgtttgcactgatagcgcttctggaagctgccttcgcaggccttcatgcgctcctgcatggccttgccggtatgattgtcgaaaatctcgtcgggcatgtcggcgacgaagaaggtccaggtggtaaaccccagccacaggcagcagaccaaggtcaccagcaggtcacccaacttgcgccgccgcttcggatcggccagcccctcggcaatgaaatcaggcaactggagcgacatcggcaacatgggtctggaatccttcgagcactgtcacgctagcacggcgcggttaagggacgattaagtccgcccatgtcaccgacgcagatctcaggctgcgctcggccggcgagccctattccctttgccggcagccgccgatattgtaggtccattgattatggtggggcttgtcgtggcctctagaggggggatcggtgcgttcatcccaggtccggatcgttacccggctgactgccggctttgccgccgtcctcctgcttacggtgatcatggccggcatggcggcacggaccatgctgagcatcgccgacctggcgggggagctttacacccatcccttcgccgtcaccaacgccctgatgcagatcgaatcgcaggtcaacgccatgcgcgccgacatgctgctgatgatctacaaccggtcggccgccgacgtggcgcggctgtcgggcagcgtggccatcaaggaaagcgagatggctgccagcctggaggtcgtccggaagcaatatctgggcaaccccgaagacgtaaagcgcctgagcgacgaattggcccagtggaaagtggtccgtgaccagaacatccgtttctgccaggaaggcgagtacgacaaggcctccgagaattcccggaaatacggttcgccccagatcgtcatcctgcgccgccatatagccggtatatacgccttcgcccaggacaaggccgccgagttcagaaacaggatcaccgcacagcgtgatcaggccgtccgcgacatcgcgctgacattgctggcactgctgatcctggggaccttgctggcccggaccattacccgctccatcgtcattcccctgggcgaattgcgcgacgtcatgcaccgcctggccaagggggaacttgacgcccacgttcccaaccagtcgcgggtgaccgaggtcagccgcatggccttggccgtcgaggtgttcaagcaggcggcgctccgcctggaacgggaccgctggatcaaggacaacctggcccggctgtcgcccgccttgcagcagaccgattccatcgccgagttcggcaccacggccctcgacttcctggtgccgctgtcgggagccggcgtggccactttcaacgccagaacgggcggcaaccggtttatgcgcgtggccggctggggcatgccccgggcgtccgagacgctcggcctggactcctttgcccccggcgaaggggtggccggcgaggcggcccggagtggatcgcccattctcatcgaggcaccgccggaatcctggctgcacgtcacctcggccaccggggccgcggcgcccgccgccatcttcgtcatgccggtgatgtcgcgcggcaccgccctggcggtgctggaattcgccagcttcaccgcgttcgacgacagccagaaagcgctgctcgaagcggctctgcccatgctggccctcaacatcgagattctcgagcgcaacctccgcaccctagacctgctggaggaaagccagacccaggcggaagaactgaaggcgtccgaggaagagctgcgcgcccagggcgaggctctgcaggtggccaacgaggaattgcgtgtctcggaggaggaactcaaggtccagcaggaagccctgcaaacggccaacgaagagcttcgcctcaaatccgaggccctggaggagcgcggcaaggcgctggaggacgcccgcgccgaggccgaccgccgcgccctcgatgtggaacaggccagtcgatacaagtcggaattcctggccaatatgagccacgaactgcgcacgccgctgaacagcgtcctgatcctggcccgcgatctcgccgacaacgacacaggcaacatgtccgacgatcaggtggaatccgcccgcgtcatccacgaaagcggcacacacctgctggccctgatcaacgacgtcctcgacctgtccaaggtggaggccggcaagatgaccctggacccggtcaccatcgccatcgccgatctggtccaggtcatccggggacgcttcgcccccgttgccaccgacaagggattgggcttccaggtggaagtcgaccccgacctgccccgctccctgaaggccgatcgcggcaagatcgagcagatcgccaacaatctggtcagcaacgccatcaagttcaccagcgagggcggcgtcaccgtccgcctgtcgctgaccggcgacggccatgtgctggccctgtcggtggccgataccggtatcggcatcgccccccaggaccgccaaagggtgttcgccgccttcgagcaggccgacagcgggacgtcgcgccagttcggcggcacgggccttggcctgaccatttcgcgcaagctggcccggctgatgggcggcgacatcaccctggatgccaatggtgacaagggtagtgtcttcacgctgctgttgcccctggcgggcaccacgcaattgccggcgccccgctgcgcccccgaaccgcgacccgcgtcggcccggccttcgccccctgcggcggaggccatcgaggaaactcccaaggccgaaggcaaactgctgctggtgatcgaggacgatcccattttccgccgggtagtctgcgacatggcccaggccaagggctttgcgaccgccaccgccggcgacggcaagactgggctggaactggcccggctgcgccggcccagcggcgtcgtgctcgatatcgggctgcccgacatgagcggctgggaggtgatcgaggccctcaagctccagcccgagacccgcgatatcccggtccacgtcatgtccgccggggacgagccgggccgggcggcgaggctgggaaccgtcggccatctgaccaagccggtcagccgcgagcagatcaacggcgccttcgaagtgctgctgcgggcccgaagggccgatggccgccgccgcctgctgctggttgatggtgacgaggccagccgcgccaccatcggggagaccctggtcggtcttgacctggacatcaccgtggccgaaacgggacaggtggccctcgagcatttggccgccggccccttcgactgcatggtgctcgacctcgccctgtcggacatggcgggaggcgaattcctggagcgggcagaacggatcggttcgggcctgccgccggtgatcgtctattccagccaggagctgagccaagaccagaccctgcgcatccgcgaattcaccgacagcatcgtcatcaagggctcacgctcctccgaacgcctgctcgacgaggtggggctgttcctccatgcggtggatgcgaagaagagcggcaaggccaagccgtcgcccgtcgccgccgaaccggtggacgccatcctggccgggcgcaccgcgctgctggtggatgacgacatgcgcaacgccttcgccctgtccaaggtgctgcgcgccagggggctgaaggttctgatcgcccaggacggcgccaaggcgctgagccagcttcagtcccgcgccgacgtggacctggtgctgatggacatcatgatgcccggcatggacggctaccagaccatgggcgaaatccgcaaggacccgcgctttgctcacctgcccatcatcgcgctgaccgccaaggccatggccggcgaccgtgaccgctgcctggcggccggagccgacgactacctgaccaagccggtggatgtggagcgcctgcggcaggtcatggccctcctgatccgcagaggcgatcatgcccagccatcctgaccggcttaagatccttgaggtcgatctgttcgtcgaggccctggcccgccgccacggctatgatttcagccattacgccaaggcgtcgctgcggcggcgcgtctccgccctggcgctccatctgggcagccccaccatcgccgacctgctgccacgcgtgctctacgacgacagcctgctgcccaccatcctctcgaccctgtcggtcccggtcaccgagatgttccgcgacccgccggtctttcgcgccatcgccgagcggatcctgccggtgctggccacctatccccgcctgaacatctggcaggccgggtcggccaccggcgaggaggcctattccctggccattctgctggacgaggccgggctgctgcaaaaggcgcagatctacgccaccgacatcaacgacaccgccatcgccaaagccgaggaagggatcatgtcggccgagcaggtcgcccgctacgacgtctcctatcgcaaggccggcggcaccaagaccctgtcccattacttcagccagggctatggcttcgccaagatcagcagcggcatcaaggaccacatctcgttcgcccatcacaatctggtgtccgatggagtcttctgcgaggtcagcatggtcatgtgccgcaacgtgctcatctacttcgacaaggcgttgcaggaccacgtattgggcttgttcgcctcgtccctgtcgcggggcggctttttgtgcctaggcacccgcgagaacctgggcggatcggccgaggcgcaccagttcctgtccctcgaccgggagttgcgcctgttcaagaagatcggagagcgggggtgaaacggatcgacgccgtcgccatcggatgttcggcgggagggatcgccgccctgcacgatattcttcccggactgcccgccgacctgtcagtgccggtgatcgtcgtctgccattccggcccctcggtccatgacctgctgagttcggtgctgcgccgcgactgcctcctgcccgtaaccgaagccgaggagaggacccccgcccatcccggccacgtccacgtggcaccgcccgactaccatcttctggtagagcccgacggcaccttctcgctgtccgctgaagagcgcatcaacaatgtccggcccgccatcgatcccctgctggaatcggcggcggacacctggggcgacggattgctggcggtattgctgaccggtgccaacgaggacggcgccgcgggcatggccgcagtcaaggcggccggtggcttctgcatcgtccaggaccccacgggagccgtggccgaaaccatgccgcgcgccgccatcgccgccgggggcgccgactggatcgcgccgctggaccgcatcgccttcctgatctcctcgctctgccagccaccgccctcctgccaggagcgcacctcatgaccgcgacccggcccaagattctgatcgtcgacgacactcaggccaatctgctggccctgcgcaagatcctcaacaagctccacgtggaggtgatcgaggccgccagcggcaacgacgccctgatccactgcctggagcatgatttcgccctggccctgctggacgtcaacatgcccggcatggacggctacgagctggccgagttgatgcggggcgagccgcgcaccgcccaggtgcccatcatcttcgtcaccgccgcctattccgacgatgtccatcgtcatcgcggctatgacgtgggcgcggtggaatacattcaaaagcccatcgacgacttcgtcctgcggtccaaggtgagggtcttcctcgatctctacaccagccgccgggcgctggagatcgagttggcgcgtagcaccgccatgacccaggtgctgcgcgaaagcgaggcccggctgcgccatgccgtatccgaagcgcccattcccatcatgattcacgccgaagacggcgccgtggtgctgctcagccgggtgtggtgcgagttgaccggctacacccccgaagacattcccaccgtgcgcgactgggcggttcgggcctatggcgaccggggcgaggagatcgccgaacgcatcaagcggcattacggcatggaaggcgcccgcgccgagggcgagcacgaggtgatcaccgccaccggcgacgtccgcgtctgggatttccgctcggcccccatcgaggccctgcccgacggacggcggctggtcatcagcatggcggtggatgtcaccgaccgccatcgcgtccaggaggaactggccggcaagaccgccgaactggagcgctccaacgccgatctcgagcaattcgcctatgtggccagccatgacctgcgcgagcccctgcgcatggtcaattccttcctgggcctgctggacaagaaattcggggccgggctgccggacgatgcccgcgaatacatcggctatgcccgcgacggggcgaagcgtatggattcgctgatcctcgacctgctggaatactcgcgcatcggccgcaagccgccaccggaccagcccatcgacatgcggatggcgctggacaccgccctgtccaatctgaccgtggccgtcgaggaaagcggcgccaccatcaacaccccggacagcctgcccgccctttgcgtcgattccggcgaattcgtccgcttgttccagaacctgatcggcaacgccatcaagtaccgctcgcccgagcgcgcgccggtggtttcactgtccaccaggctcaagggcaatgcctgggaattccgcatcgccgacaacggtatcggcatcgagccccagtatttcgaccgggtcttccagatcttccaacgcctgcattcgcgggtcgaagcggcgggaaccggcatcggcctggccatctgcaagcgggtggtcactcgctatcgcggccgcatctgggtcgaatcggtgccgggcgaaggctcgaccttctgcttcaccattccggtggccaagccggcgacatcgtagtcttgacggtctgcgacaaagcccgcttcgcggcagggctaccgccctgacccgttcggaggcacggcctccgaacctccagcttttcaaaaagcagaagggttcgggaagctgtgcttcccggttggggggatcgggggcaaacgcccccgaagcgacgttttttcagcagcctgtcaaaccgggcagccgtgggcgtccctcagcggaacagcatcttggagatcaggacttcccgggtctgttcgcaaccgggttccttgcgcaccagttcgagcatggtggccttgatcatgggggccggattgctgctcatgtattcctcgtagggaatgccgttcagcaccttgcgcatcttgtccgagatggccttctcggacaccttggcctcctcggggaccagcatcagcagatccacggtggacaggtggaaattgccgtaggaatcccacagctccagcgcgatggtgggaatgcggacgtagcgctcgcccttggagggaatgggcagcggcgcacccttgccctccttcttcttatcctccttcttcttctcctcggccaaggcgagggagggagcgaggcccgcggcaagggccgcgacaagaaagcggcgccggtcgatcattctagtctccatcgtgggagaggatgacggtggcctcggccagttcggcgcccatggcgcggatgttgcccagcagggcgttgacgatgaccttgacgcccttgggggccttgtccaactgctcggacaggcggtccttgccgatgatcacgcaggcggtctcctcctcggccaccgccgaggccatgcgcggatgatcgtcgatcagcgccatctcgccgaagatgccgccctgggtgacgtcgccgatattgacccgcttgcccttgatggtcttgaacaccgagacgcggcccgattccaccacataggcggtggtgcccggctcgccctcggcgaagacggtggcgcccttggggaaaacgacgcggcgggcggagttgttcatgggcggcctctggcgtttcagtcgacgcggcggatggagaagttcttgggcaccaggatggtgttctggggcggcgcgatggtgtcgggcgccgggaaatcgatggtgaagtgcagcccccggctttcgcgccgggccagggccgaacggatgatcagatcggccaccatggacaggttgcgcagctccagcaggtcggaggtgacgcggaagctgccgtaatactcgtcgatttcgtccttcagcagccggacccggtgccgcgcccgctccaggcgcttggtggagcgcacgatgcccacatagtcccacatgaagcggcgcaactcgtcccagttatgggcgaccaccacctcttcgtcggaatcggtgacccaggtctcgtcccagggcgcgatctcgggaatatccgacagggtgccgattcgggccgcgatgtcgcgggccgccgcggcgcccagcaccaggcattccagcagggaattggaggccatgcggttggcgccgtgcaggccggtgaaggccacctcgcccaccgcgtaaagattgtccacgtcggtgcgcccggccagatcggtgagcacgccgccacaggtgtaatgggcggccggcaccaccggcagcggctccttggtcatgtcgatgccgaacttcagcgcctcggcatggaccgtgggaaagtgggccttcacgaactcggccggcttgtggctgatgtcgagatagacgcactcgcagcccaggcgcttcatcacgtcgtcgatggcccgcgccacgatgtcgcgcggcgccagttcacccctgggatcgtaatcgtccatgaagcgggtgccgtcgggacgcagcagcaggccgccctcgccccgcaccgcctcggtcaccaggaaggacttggccttggggtgaaacaggcaggtggggtgaaactggctgaattccatgttggcgacacggcagccggcgcgccaggccatggcgatgccgtcgcccgtggagccgtcgggattggaggaatagagatagacgcggcttgcgccgccggtggccagcaccacattgcgggcggcgaagcgatggacccgaccgtcgcggcggtccagggcgtaggcgccgatgcagcgccccaggcgcccctggggcagcttctcgcggatcagatcgacggcattgtgatgctcgaacagatcggcgccgctttcccggatgcggctttccagcgcgtcttccaccgccttgccggtggcgtcggcggaatggacgatgcgacggtgggagtggccgccctcgcgggtaaggtgaagctcgcccgcctcgcggtcaaaggccactccattggccaccagccattcgatggcctccctggcgccttccaccacggcccgcaccgccgattcgacgcagatgcccgccccggccaccagggtgtcggcgatgtgggattcggtggaatcggcggcgtccagcaccgcggcgatgccgccctgggcatagcgggtgctgccctcggacaggacggtcttggccagcacccccacccgggccttgggattggccgccagcacgcccagcgccaccgagaggccggcggcccccgagccgatgaccagcagatcgtaaggattcgccgccttgctcatctcagctccagtccagcccgatatcgaccgccggggccgattgggtgatgcgtcccaccgagacgaagtcgactccggtctcggcgatggcgcggatggtgtccagcgtcacgccgcccgacgcctcggtcttggcccgtccggccacgatggccaccgcccggcgcagcacgtcggggcccatattgtccagcagcacgatgtcggccccggcctccaccgcctcggccacctgttccagggtgtcgcattcggcttcgatattggggcggccctcggccttggcgcggcgcaccgcctcgcccaccccgccgcacacggcgatgtggttgtccttgatcagcacgccgtcataaaggcccatgcggtggttcttggcgccgccgcaccgcgtagcgtatttggacaggcgccgcaggcccggaatggtcttcctggtatcgagcagggtgcagcctgtgccctggatgcgcttggcatactgactggtcagtgtggcgatgcccgacagcaattgcagcaggttcagcgccgtgcgctcggcggtcagcaggccacgggccgggccctccatctcggccagcaccgtgccggcctccaccgtgtcgccatcggccacgcgggctgtgaagcgggcttcgggcaccaccaggcgaaagacctcctgggccaccggcatgccggccaccaccatggtatggcgcgccgccatgattccggtgaagcgcagatcggcagggatcaccgaggccgaggtgatgtcctcgccttcgccgcccttgtccgcccccgtgtcctcggccagcgcggcgaggatgacccgccgcgcgtcgtcccagtcaagctccgcctcaggccgcattgggcttgtctccggacatggggaccgacttgctcatctccagcatgcgctccagcggcttcagggccgcgacgcgcagatcctcgggcacggtgatggcgggggcgtcgttcttcaggcagagatagatcttctccagggtgttcctggccatgaacgggcagttggagcacgaacagccgccatcggcgccgggggccggaatgaaggtcttgtcgggcgccgccttgctcatctgatggatgatgtgctgctcggtggcgatgatgaattccttggccgagctggccagcacgaaatccaggatgttgcgggtcgagcccacatggtcggcatggttcaggatgctgtccgggcattccggatgcgccgccaccagggccttgggatggcgaaccttcagcttgaccagctccttctcggagaattgctcgtggatgatgcagctgcccggccacagcgtcatgtcgcgcccggtcttcttctgcatataggcgcccagatggcggtcgggcgcgaacaggatggggcggtcggcgggcagttggctaatgatcgcctcggcattggacgaggtgacgatcacgtcggacagcgccttcacctcggccgagcagttgatgtaggtgaccgcgatatggtcggggtgcttttcccggaaagcgcggaacggctcggggcgacaggattcctccagcgagcagccggcttcggaatcggggatcaccaccagcttggacggcgacagtatcttggccacctcgcccatgaagcgcacgccgcagaacacgatcatgtccgcatcggtggccgccgccttgcgcgacaggtcgagcgaatcgccgacgaagtccgccaggtcctgaatctcgccctcttggtagtaatgggccagaatcaccgcgttgcgctccttgcgcaggcggtcgatctcggcgaccagatcgagggtcgggtcgatgtcggcttcggtcatggcgccgggcgcgggcaaaacaatggtgtcggtcatcggtctgggctctctcccgggggacggattcccccgcttcactaagggggaagtaaaggacgaatcgcgggggcaaagcaacccttcacccaccccgacaggcagttcgccccccaccagcgttgtgtatagggcgttatgaccaccgcgtgcttcacttggacactgatcacgagcatcatggatatgggatgacggattggatttcagcatgatgacgtcagaaggacggactccgcaggtgcccgacgcaaccgctttgccgccgctggtggtcgtcatcgaagacgaggccatcgtgctggccggctatcagatgctgttcgaaagctggggctatcgcgtcatcgccgcccaatcggcggacgaggccgtctcgctggtcgaggaggagggcgaggcccccggcttcatcctgtcggatttccgcctgcgcgacggccagaccggcaccgaggcgatcagcatgctgcgccgctcgttcggccagggcatccccggcgccgtggtgaccggcgacaccaccgtcaccggtgagggcctgaaggaggccgaggccgagggcacccccatcctgcacaagccggtcaacggccgccagcttcaggacatcctgtcccgctcgctgggctgagcgtcacgacagccgccggaccagcttccgcaactcctccagcaccagcaccgaggcccccagggccgcggcgattccccactccgccggatcgagatccgtggtgtggaacagggcctgggccggcgcccagtggaccgccaccacctgcagcgccacgatgccggccagggcgccccacagcttggcattggccagggcggcgcggccgaaggcgctttccgcccccactcgggcattgaacacgttgaacacctggaacagcacgaaggtggtgaaggccatggtgcgggcccggaccatgtccccgccgccgccctcccaccacagcactcccagggtccccagcgccatcgccacgccgaagctgaacaggcgaagcaggcgggacagcggcagaatcgaagcgttctgcggccggggcggctgatccatcaatccgcgccgggcgggatcgaaggccagggccatggcgggcggcccatccatgatgatgttgacccacaggatctggatgggactgaacggcaccggcaggccgcaaagcggggccagcagcaccgccagcagggcgcccatgttggtggacaactggaagcgcacgaacttgacgatgttgtcggtgatgatgcggccttcgcgcaccgcgccgaccacggtggagaaatcgtcgccggtcaggaccatggcggcggcctcccgcgtcacgtccgagccggtccgccccatggccaccccgatatgggcggtgcgcaaggccgccgcgtcgttgactccgtcgccggtcatggcggtgacatggccgcaggccttcagcgcccgcacgatacgcaccttgtgctcgggcgtgacccgggcgaagaccgcgatggcctccacccgccgggccagttcgacatcgctcaggccatccagctcgccgccgtcgaccgcctcgccatccaggcccagttggcgggccaccgccgccgccgtcacccggtggtcgccggtgatcatcttcaccatgattccggcggcgcggcaggtggcgatggcatcggcggcgccggggcgcggcggatcggccagcccgaccagggcatgcaggaccagcccgcccaggccggcgccaaggtcctcgtccggttgggccgggcgcgacgccagggcgatgacccgcaatgcccgcccgcccatccgctccatctcggcggccaggacccggcgctgctcggcgtccaggggccgggctccgtcttcggtcagcacagtgtcgcacagttccagcacccggtcgggcgcccccttgaccgacagacggcaggtctcgccatcgccgtccagggtagccatcagcttggacgccgagctgaacggcacctccgccagccgtcgccagcgtccggggggcggcaaggctcccgcccgctcggccagccgcagcagggccacctcggtgggatcgcccaccggctcgccggtggcggcgttgaaccgggcctcggtgcacagccccgccggagccagcccccattccagaccgaccggtcggtcatcaccggcaaagccgtggcttcgccccagcgcccagccctccagggcggtcatccgccccagggtcagggtgccggtcttgtcggaacagatgacactggtggagcccagggtttccactgccgccagccgccggaccaccgcgcccttggccgccatgcgcaccatgcccagcgccagggtgacggtgaccacggcgggcaggccttcgggaatggcggccaccgccagggcgacggcggtcagaaccattcggcccaggggctcgcccgccagcaggccctggaccaggacgaaacccaccacgattgcggcgatcagcgccagccgccggcccaactggtcgagccgctgctgcaacggggtcggcccgtcctcggcggcgtcgagcagggcggcgaccttgcccatttccgacaggcgtcccgtgccggtcaccgccatctcggcccggccccgggtgatcaccgagttcatgaacagcatgttgacgcgctcggccaggggcgtgtcgtcgcggtcaagcgcgccggtgatcttggccaccggctcggactcgccggtcagcgccgcctcgtcggcctccacgtcctgaccgtccaccagccgtccgtcggcgggcacccggtcgccggccttgagcagcaccaggtcgccgggcaccagaccctcggcggcgatgaccgcctcgcccgcggcgcgccgcacccgcgccttctgggccagcatggccttgagcgcgcccagcatgcgtccggcccggcgctcctgggcgtaaccaagaaaggcgttgaacagggtcaccgccagcaccaccaccatgtcggaggtgtcgcccaccagcccggccagcacgccggcggccagcagcatcagggtcagcagattgcggaattgatcaagaaaaaccgcccaggccggcctgggcggtttttctggaaggcggttcagcccgcatcgcccgcggcgggccaggatctcggcctcggccagcccctcggttccgcatccgagacgggcgcgaaccgcgtccgcaccaagccggtgccagacgggctcgccgtcagagtgcggcatcgggggcggtcagccccagatgggaggcggcaaccaccgcacgggtccggttgttgacgttgagcgccttcaagatggcggtcacgtgcagcttgaccgttccctcggccagttccagcacgcgagcgatttccttgttggacttgccctggcccagcagggccagcacttcgcgctgacgcggcgtcagcgaggcgatggccgattcgccggccaccggcgccccgtcatcgccgcccggaccaccctgctccagcagggccggcggcaggtagacgccacccgacagcaccagcttcagggccgacagcatgacccgcgaggacgaggtcttggggatgaagccagcggctcccatattgaccgcctgcagcacatggcggcggtcgtcggaggccgacagcacgatcagcggcaccgtcgacggcagcaattccttcagcttggccagcccctcggtccacgccatgccaggcatggtcaggtcgagcagaacgatgtcgatgtccttctcgctctggacagcggcgatggcctgaggaaagtcacaggcctcgatgatcgtgggcggcccttcgaactgatccaggacatggcggagcccgtcacgaaacagttcatggtcatcggcgataagaatcttcatctcgtccccaccatgcatctcccggcatctaaagcgccaccacccatctgcgacatggtcgcaagaataaggcgccaccgccacgaaaaaaaacgcaacgcaccacgacttttgccgcaagtcggaaagcattggaccgcgacggtccctagccttcacgcctgacttccagtatggtccgccgccatgagcacgcccatgaccatctatcatgtatgccgtcggaccgagtggcaatatgcccagacgacaggggtatatagcggttcgtcccaggacgaggccgacggctttatccatttctccggcccggcccaggtgaaggccagcgtcgccaagcatcgtgccggacaggacgggctggtgatcgttgccgtggcgccgcagccgctgggcgccgccctgaagtgggaagcgtcgcgcggcggccagttgtttccccatctatacggccccctgccgctctcggcggtaaagtgggtggccgacctccccctgggccccgacggcgcccacgtcttcccagcctccctggacgcggacggcgtccaggctcgcccttccatcgaggactgaccttgaactacttccgcctcgccggaccgctggtccgcctgctcgacgccgagatcgcccatggcttgaccatcggcctattgaaggccggtctggtgccgcggcaaccgaccttcaaccccgaggcgctgaaggtccggctgtggggccgcgacttcgccaatccggtggggctggccgccgggttcgacaagaatgccgaggtgcccgacgccatgctggcccagggcttcggcttcgtggagatcggctcggtgacgccccggccgcagccgggcaatcccaagccccgcatgttccgcctgcccgaggaccgggcggtgatcaaccgcatgggcttcaacaaccagggcctggaggcggtggccgcccgtctggcggcgcggccgcgcaccggcatcgtcggcgccaatctcggcaagaacaaggataccgaggacgccgccgccgattacgagaagggcgccgcccggctggcgccgctgtccgactatctggtgatcaacgtctcgtcgcccaacacccccggcctgcgcgccctgcagggccgcgaccagctggaatccctggtgggccgcacccgggccgccctgactgcggccatgccgtccggggcgccgccgctgctgctgaagatcgcccccgatctggcctgggaggacctgtccgacatcgccgccgtggcgctggagggggccttggacggattgatcgtctccaacaccaccgtggcgcggcccgaatcgctccgctcggccaatgcgggccagaccggcggcctgtcgggcgcgccgctgttcgaatcctccaccgccatgctgcgccgggtctacgagctgacccggggcaagctgcccatcatcggcgtcggcggcatcgcctcggggtccgaggcctatgccaagatccgggccggcgcctcgctggtccaggtctattccgccatggtctacgaaggccccgccctgatcacccgcatcaagcacgagatggtcgacctgctggcccgcgacggcttcaaatccatcgccgaggcggtgggtgctgaccatcggggccagggattgtgattccgctgatttccggcctgtcggccgtcgccggccgctatgacggcttcgtgctcgacctgtggggcgtcatccacgacggcgtcgtcgcctatcccggcgtggccgagaccctgaccgccctgcgggcggcgggcaagcgcaccatcatgctgtcgaatgctccgcgaagggctaccgccctgatcgagcagctgacccggctgggcatcggacgcgacctctatgacgaggtactgtcctcgggcgaggcggtgcatctggacctggagcgccgcagcgatcccatcttcgccgccctagggagcaaactctaccacctggggccggagcgcgaccgcaacgtctatgaatccttgccttaccggtcggtcgaccttgaaagtgccgatttcgtcctcaataccggcccggtggaggtgacggaaaccgtcgccgattaccaggcggtgctggaccgcgccctggcgcggcggctgcccatggtctgcgccaatcccgaccacgtggtcatccgccagggcaagcgcatcacctgcgccggcgccatcgccgaccgttacgccgacatgggcggacaggtggtgcagcggggcaagcccgacccagccatctacgaggtggcgctggccgccctgggcatcgccgaccggacgcgggtctgcgccgtgggcgacgccctgcacaccgacgtcaggggcgcccgggccggaggcatcgacgcggtgctggtcaccggcggcatccacgccgacgagctgggcatcaaatggggcgagaccgccgacccggcccgcctggccgagctggcccgccaccacggcgagacgccggtcgccgcgcttccgaaattcatctggtaaggagattcccatggcccagcacgaaaccgatgcggtaatcgtcggcgccggcccggtggggctgttcgcggtattccagtgcggcatggtcaaggtgcgctgccacgtggtcgacgccctggaagccgtcggcggccagctctccgcgctgtacccggaaaagcccatctacgatattcccggccatccctccatcctggcggccgatctggtggagcgcctgtccgagcaggcggcgcccttcgcccccacctatcatttcggcacccaggtcagcacgctttctcgcctggacgacgggcggtggctgtgcggcctgtccaacggcgacagcatcgcggcccgcgccgtgatcatctgcgccggcggcggcgccttcggccccaaccgcccgcccctggatgggctggagcagttcgagggcaccggcgtgttctacctggtgcgcaagcgcgaggatttccgcggcaagaaggtggtgatcgccggcggcggcgattcggcggtggactgggccatctcgctgtccgaggtggcggccaaggtcatggtggtccatcggcggccgaagttccgcgccgcccccgaatccgaggcgcgtctcaagcaactggccgaaaccggcgcggtggagctggtggtgccctaccagttgcacggcctggagggcgagaacggcacgctgtcggcggtggtggtcgccaccctggagggcgaaaccaagagcctgccggccgatgtgctgctgccgttctacggcctgtccagcgatctcggccccatcgcccagtggaatctgggcatggaccgcaacctgatcgccgtcgacccggccaccggcgccaccgatgcgcccggcatctacgcggcgggcgacatctgcacctatcccggcaagctgaagctgattctgtcgggcttcgccgaggccgcccgagtcgcccattcggcccacgacgtggtccatcccggcgaggccctgcatttcgagcactcgaccacctcgggcgtaccgaagggttagtcccccgccccgaagaactccagctgccattccatctcggcggcggacagggggtggtcgccccgcgtgggggccaggatcttggagggcgacaggcgcagcagcttgctctgaagctgggcgccgaagccggcggacaggccggctttccaggtgaccgccaccatgcccttggcgctcttggtgtagaccaccttgcgcaccgccttgggcggcagccccgacagcaccgccaaacccgccgacacgaaggcgtaatcccccgacgacagggcggtatccatggcggtctcggtcaactgcccagcggcgtgcagggcgcgggcccgctggagggcggcggcctcgtcggcgtcgcgcttggcctcgcccttggcgccgccggcatcgtcctcgatctcgccgatgcggcgcgacaccaccgcggccacggcggcgatggcgtcggcatccaggtcgcggcgctcggacagggtctggagcaggctggccgcgacgaagcgggccagtttctgcgccgtccgggcggaaagctgcggccgctcgatcatgggacggtgccaggcctcgatatcggcggcgcggtcagccagacggtccagggtctcttcccggatctgggcggaaggattgcccagcagcacggcgatggcgtccacgtcgtcggtggcggcaatggcgtcggccaccttgacgttgaccaccgagcgccgcgagatgcaggccagggcaccgggaatgggaccggcaccgatgatctccagcagatcctcgtcggtcagcaccggcgagaattgcagcaccggcccggccaccaccagttcggcatcgcgggccaggcggcgaatcacgtcgggcggggcatgggccacgtcctgcagcgcctcggacagaatctggcgcaccttgggaatctggtcgcgggccagcatctccagggattcgaaggtcatgcggcgcaggcggtcctgctcgtgggcggacaggccgggggccacccgggcaatcttggcggccagatcgccgcgcaccgcgtcgctctgatcggcggcgaggcgcagattggcctgggcgggggcgtggggattggcggccacctggcggcgcacctccacatccgcgtcctcggccaggaagtagaggatctcggccttgacgtcatcgcgggccgccagttcggcgcgcaccttggaatcgggatgggcggccagttccttggcctgctcgtagtccagcggtcccttgcgcccggcgccgaacaagcgcttgagaaagccggtcacgcggcgcctccgtcctcggcggccggcgcgatgcgccaagcacccttgccgctgcgcttgacctcgtacatggccttgtcggcgcgggcgatcaggtcttccagcgcctcgttgtagctgccgccatgcaccgccacgccgagggaacatcccaatggcttttccggcgagccggagaagcgatccagatccttggccgcctccagcacgtcctggcagcgcttgacggcgatgtgctcctcggcggcttccagccagatggcgaattcgtcgccgcccaggcgcgccaccagatcgatgggccgcgtgtgctgcaacagcaggtcgcgcaccgccagcagggcctcgtcgccggtctggtggccgtggacgtcgttgaccgccttgaagttgtcgagatccacatagatcagggccgccggcttgccctcgcgcttcaggcggtggaagcgccgggcgatctcctcgaagaaggcgcggcggttgaacagcccggtcaggccgtcggtgcgcgacagcttgaccatgcgctcgtggttggtgatctgctcggaagccagacccacctggttggccacgtcgtcgatgagcaggcggtcgtcgtcgctccaggcggcgcggctcatctcccgccacagcagcacggcgccgttgatggagtggcgatagcggcagacgctggccagcacccgccagtcgcccaggtcggcgtcgtaatggtcgctggcctcgaaggtgtcgagcaccggacgggcatcgccgaaggtgccgtattcggccgatggcgcgaaatcggaatcgtcggactggatgcggaagatctggcagccggtggcgcccagcgcccgggcggtggcctcggccgccgccttcagcatgtcggccgggtccacctcgtcgcggatggtgcgcacgatgtagctgagcaggcgttcgcggttgttggcgcgcgacagcgccgcgtcgcgcagccgctcctgggtcacgtcgcggcagaccccgcgggcgccgcgccactcgccgccatcgccccggatgggcgtggacgaggccagaaggcagagcggattgccgtcggactggcgcatccatacctcgatgtcctccaccggcgacaccgcgtcgaaggggccggggccgtgggtgctttcctcctgcagcacgaagtcggcgggacggcgccccaccagttcgtcggcggcgaaacccagggcgcccttggggctgacgaagacgaaatggccgtcggcgccggtctcccaggcgaaatcgctggaaatctccaccaggtccttgtagcgctggcgcgattccaccagggcggcccgcaggttgcgctccagggtcacgtcgcggccgaacagcacggtctggccgccttcggtgggaatggacaccagatcgagaatcagggtgccgccgctgaccagcggcagactctccaccgaggtggcaccgggctgggccagcagggccgaaaggcagccgagccggtcctgcgccaccgcctggaccagcggctcggcccggtgattggcggccaggatggaaccatcatggtcgagcagcaatgcggggccgggaaaggcgttcaacccctcggcccccaagaccagcatgggccgccctccttgcggggacttcgccctggatttttcccctgatgtgctcattgagtgcggatccggcccatcctgtcgtccttagttcctaccataggcataggcgcttaacgatcccctaaaggggggtgcttgccacggaggccggggcgcgctacctcttgtggccatggacaaggattttcccgacctgtcgcgtatcgagacctgggtcttcgacctggacaacacgctgtatccggcgtcgtccagcctgttcccccagatcgacgtgcgcatgcgccgcttcatcgccgaccgcctgcatctgtccctggacgatgcctatgccctgcagaaacgctattacaaggaattcggcaccacgttgcgcggcctgatgctggtccacaagatcgagcccgaggcctttctcagcttcgtccacgacatcgactgcacggtgctggacgccgccccccggctggacgcggcgctggccgccctgtccgggcgcaagctgatcttcaccaacggctcggagcgccacgccgagaacgtgctggcccgcctggggctggcccggcatttcgaaggcatcttcgacatcagggccgcccgcttcatccccaagccgcagccggaatgctaccggctgatgatcgaccgccatggggtcgaccctcatgccgccctgatggtcgaggatattcaccgcaacctgcggcccgccgccgatatcggcatgaccaccctgtgggtcaaggaggacggccaccccgataccgaggtgctgggtcaggatgcgggcgacctgtcgcatgtccaccacatcaccgacgacctcgccgcctggctggaactggcggcgaggccttagggtacttcagcagttccacaccacgtagccctgggtggtcaccccatggttggccaggacctgctgggcatcgggatacaggctggcggtgacgatgctgggaatgaccgcggcccgggccttggcgtattgcgcccaggtcaccgtggttcccgaggtgatctggtagtcgttggcggtctcgtcgccgttggtgtagagctgcggcgacaggaagtcgatattggcgtcctggaagaacgccgccatcagggtgtcggcatcgccgatgccgtagggggcggtgtggctgaccgtgaccagaaccagaaagccgttggccttggccagggcgaaggccccctggaacgccgaggccagcccgctgtcgccattctcgatgtcgtaggcgatgccgccataggcggcgaattgcccgccggtgatggccgcgttgatcttgtccagatcctgggcggtgaaccgcccattgtcgttgccgccccccagggtgatgtatttgacgccctccagcccgctcagggccgccgcgctgtcggcaagcgccgaggccggatcggcccagccgctgaaggccagtcccagggtggcacccgacggaggcacgcacgccccccaggtccggcgccaatagccgatattgggcgccggaaccggctcgggctgcggctgggcggcggcgggaatgctgatcaccatgccgacctgcaggctggcggcgggcacgccgggattggcgccttcgatatcttgcgcggtcacgccggcgcaggcgttgatattggtcgcgatctgccagtaggaatcacccggctggaccacgtagcgcaacgccaccgcaccggtggacggggtgggaatattgatggtctgcccgaccagcagccccgacgcggaaatcccgggattggccgtttcgatctggctggcgctgacgccggcacacgcattgatgttggcggagatctgccaatacgagtcacccgcctgaaccgtgtatttaagagcaattgacattgcatgcacatccttttcgggattttttcaccgaaatacagtgcttgcaatattacttacagacaacatcatcttataattgccgaagccggcaagaaatgaagcccggcgggaccgcatccccggccgggctccgccgctcgtcagccttgaacggtgcggaccccttccaggaagcggtcgacgacgtccttaagctcggtggcctcgcgcgacaacgactgagccgccgacagcacctgcaccgccgcggcgtcagtctcggcggcggtggccgacacgccccccacattggccgagacctgcctcgtgccctgggaggcctgatccacgttgcgggcgatttcggcggtggcggcggattgctcttccaccgccgccgaaatggcggtggcgatgtggttgatctcctcgatccgtccaacgatgctgccgatggcggccaccgcctcccgggtggcggtctgcacggcaccgacctgggtcgagatctcctcggtggccttgccggtctggttggccagggcctttacctcgcccgccaccacggcgaagcccttgcccgcctcgcccgcccgggccgcctcgatggtggcgttcagcgccagcagattggtctgggcggcgatgtcgttgatcaggctgaccacgtcgccgatgcgggtggagctggccgccaatccctggacgatggtgttggtctggcgggcctcgtccgaggcctgctgggcggcggtgctggactgggccacctgacgggcgatctcggcgatggaggcggacagctcctcggcggcggtagccaccgtctcgacgctgctggaggcctcctcggccgccgccgccacggccgtggccttgtcctgcgtctgctcggcgatggtctgcatgccctgggcggtggcgtgcaactcggtcgccgcccccgacaccacctcaaggacgcccgaaaccgtgcggtcgaaatcccgcgccagggaatccatggcccggccgcgctccacccgctcggtcaattcagcctcatgctcggcggtcaggcgctcggtctccaccatggcgtcgcggaacaccgccagggacgaggccatccggccgatttcgttggtcagccccaccccgggaatatgtacgccgtaatcgcgctgccgcagcttgtccatggccgccgccatggcatcgatgggcgcggcgatggtgcgcttgccgatcagggaggccatggcgccgatcagcccgatgccggccacggtgatcaggatgctgaggcgcagcttggcgctgcgcacccggtccatgttggccgcggtctcggcaatgtccttgttgttgatgtcggcgaacgcctgggtcagcttgttgagctcctgccgggacttgcggttgacgtcgttgtcgccgaattcacggccggcgggaccgccctcggctcgtccgatgcggaccagctccttgcggaatccggcgaactgggcggcgctttccttcagcttggcatagtcggcctgctgcgacggcggcaccatggcgccccattcggcgatattgcgctcgaaccgcccgatggtctccagcaggggggtggcgaatttttccacctcggccggcgattgcgccatgtagatgccgcgcgaatccatgacgatggaaaggatcagggcgttggtgcgctcgccgatgatggcgcgggccgccgccttctcgatctcgccggactgttcgtccagggcctccatgccggtgatgcccacgccgccgatcaccacggccagcaggctcatcatccccaccaccagccacatcttcagagagacggtccaattcgacagcatgttcggcccccaccgcatgaaccagatcgaaagacctaacatacactttacttattgccagaccatacgggggaaacccgcagcaaaccaaagcaataccctgaggcgaccacctccccgaaacagtctggaaatagggctgaccgcgatcaaaggttccgtcatagtttggcgacgacggcctggatactacctggaggaatgctggcaccaccggtgcccagggccgacatcctaagtcttgagaggagagcgcagtgcccgtttggattgagacaagctggatgtatcagcgattcggcgatcaagtgaagaccagaagcagtgacagcaaaagctggaagacaggcatatgggaggagaacacatggagcccggactatgacgcgctccggtcctccctgatcaagctccaggaatactgcaacgacaaccagtttcagatcatgtccgtgcttcccctcaccgaggcgcactcatacgaattcgggcagggcgagttcgttctttggccgggaaatgcctcggccggcggctggggggtgggccagggatggggcgtttcgcaagtggtgggcttcgccgcgctgcttcagaaggtcgaagacgtctcgcaggaagagttcgaccgccgcaccgccgaaaagaaacgccagaaggacatcgagcgccgcaacctcgaggcaaaaaaattaagcgccgacatcgagacatccatcgaagaaatgcgcgacctggaacgagacgccgccgatctgcgacgcaaggtcggccagcccgtaacccagaagaccggcctccttggcggcatcaagttcatcgtcgacggacgcgacttcaagagcgaagccgaggccgtcgactatcgcaatcaaatggccgccaaggcggacgccctggaatcgtcgatcctgacgatgaaacagaacatcgaggagagccggctgaaaatcaaaaatctgcaagccggtccagacgccgcgaacaccttggacaagccatgaaccggcgatgagataccgcctgctcctcgtcgacgagcccccccccccccggggacgatcaccactggtgggtcgcccgctccgtcgaggctgcggtcggatgcgtggaggaacacggcgcccccgacttcgtcagtttcggcaacgacctcggcgaaggcgttcccgaagggccgcgcggcagactaaaggccgtccgaagggaggcggacgcagaatcctgattgccgcgcctcgtcccaaccagtggtggcccctgccggaatcgaaccggcacgcccgaaggcgagcgattttaagtcgcttgcgtctaccagttccgccaaggggccttgggggaagtccgcacccgttcgaggcggtgccgaccttatagcgcaccccggcgtgcgccccaagcccctgtggactccattcgacccgaaccaaacactcattgctaatatgagtacatccatattaaatgatgtagcggctcgttcttggggatacctgccgccaataaatcactttcggcgtgcacacgcgcggcgaacctgagggggtcgggcggctctcgggcgctgcccgttgcctccagggccggtcgaggtgactgacgtctttcaggggaaggaacaggatcgatgggttttggcatcgccgcgcgcttcggcgccgcattggtcgccatgtcggtgggcaccgccgcgaccatgggatggttcagcaacaaccacgcggtcacgctgatcgagcaggcggaacaacgggagctgatggggcgcttcgagcaattgtcggacgccatcggcggctcggccgatcaggcgcaagccatggccgccctggtggccaatctgccgggaattccccatctggtggccacgggaagccgcgacgcgctggcggcgcagatggtgccggtgttcaaggccatggcgcagcccttcggcatcgagcagttccagttccacactccgcccgccacctcgttcctgcgcgcccactctccggccaagttcggcgacgacctttcggccattcgccagaccgtggtggaaaccaatgccacccaaaaaccgacccatggcctggaatatggcgtggccggactgggcgtccgcggcctgatgccgctgttcgacgagggccggcacatcgggtcggtggagttcggcctctccttcggcccgcctttcttcacggaattcaagaagtcgttcggcgtcgatgtggccctgcatgtcaaggccaaggaccagttcaaggtcttcgccggcaccatcgcccagtcggcgctggagcccgccgagatcgccgccgccctgggcggccgcgacatcatcaaggcggtggaggacggcaagggcggccgcaccgccgtactgggccgggcggtgaaggattacagcggcaagccgctgggcgtagccgagatcgccatggacgccagccactacgccgcccagctggccgaggcccggcggaccatggccggactgattcttggcgccatcctggtgtcgatcgtcctgagcgtgctgctcagccggaccatcacccggccggtcctggccatgagcgccgccatggaccgcatcgccaagcgggacttcgccgtggacatccacggcctcgaccgcaacgacgagatcggccacatggcccgcgccgtcgaagtggtgcaaaaggaggtggagcgcaccgccgaactggaagtggcgcagcagcgcaacctcgtcgagctggagaaggggcagaaatccctgaaggacggcatgcaactccagttggagggcatcgtcgaagccgccatgcagagcaacgaggccggcgtggtgctggcccgcatgtcggggtcggtgcgccgcgcctccgagcaaagccagtccatcgccagcgccatcgagcaacttgtggcgtcggtgggcaccatcgcccagtcctcggaaatcgctgcgggggaggcctcggacgccgaggccgccgccaaggagggcgtctcggccaccgccgccgcccgccgggccatggacgggttgctggaagcggtgtccgacgtgggcggcaagatcgaggccctgtccaacgcctccgaccagatcgccgccatcatcgaccagatcgaggccatcgccggccagaccaacctgctggcgctgaacgccaccatcgaggcggcgcgggcgggcgaggcgggcaagggctttgccgtggtggcgggcgaggtcaagaccctggccaaccagaccgccaaggccaccgtggacatccgtgcccgcatcgaaggcctggtcagcgacatgaacggcgcccgcgcctccatggaacgctcgcggggcgccgccaatgacggcatggccgccgtgggccaggtcaccggcggcctggaggccatcgccgggcgcatcgatggcgtgacgcggcgcatgcacgacatcgccggcatcctcagccagcagaacgccgccgccactgaggtctcctcggccaccggcgagatcgcctcgctgtccgagcacaatctggaggaaatcgcccaggtcctgggcgccatgaccgaggccgcctcggttctcgaccgccgggctgaggatttcgccaagctgggcacctcggagaccctgctgcaggtggccaagaatgaccatatccgcttcaagcgctccatcatcgaccgcatcatgggccgcaacgacctgactccggacaggctggccgatcaccacacctgccgcctgggcaagtggtacgacaccctgaaggacgaccgcctgaccggcctgggcgcctatggccgcctgctcgatccccatcagcgtgtccacgcccacggcaagcgggccttggaactccacgcccggggcgagaccctggccgccatggccgaggtcgatctgctcaaccaagcctcgcacgaggttttgaccctgctggaggaaatggcccaggcccttcgtgccgccgcctaaaaaccggcctttaaaggacctgaaaccggcccgcaacattgacagatggcgggccggcctctatctcttgccggtcgcgataggccccttcgggggtccgctcacttatcttggggaagcttcatgttcggcgcccttgcccggcggatcttcggaaccgccaacgaccgtgtactcaagccgctgaagaagcatgtcgaggcggtcaacgccttggaacctgccttcgagaagctctccgacgacgagctgcgcgccaagaccgccgagttccgcgcccggctggagtccggcaccgaactgaacgacctgatggccgaggctttcgccacggtgcgcgaggccgccaagcgcacgctgggccagcgccacttcgacgtccaactgctgggcggcatggtgctgcatcagggccgcatctcggaaatgaagaccggtgaaggcaagaccctggtcgccacgcttccggtctacctcaacgcgctcaccgccaagggcgtgcacgtggtcaccgtcaacgactatctggccaagcgcgattccgagtggatgggccaggtctaccgcttcctcggcctgaccgtcggcgtcatcgtccacggcatggatgacctggagcgccagcaggcctatgcctgcgacgtgacctatggcaccaacaacgagctgggcttcgactatctgcgcgacaacatgaagttccgcctggaagagatggtccagcggcccttcaactacgccatcgtcgacgaggtcgactccatcctggtggacgaggcgcgcacgccgctgatcatctcggggcccaccgaggacaattccgacctctaccgcctggtggacaagctgatgccgtccctggtggccgaggacttcgagaaggacgagaaggtgcgcgccgtaacgctcaccgaccgcggcaccgagcacgtggaagagatgctgcgcaccgccgacctgatgaaggggacgctgtacgacatcggcaacgtctccctggtccatcacgtcaaccaggcgctgcgcgcccacaagctattcacccgcgacgtggactacatcgtcaagaatgacaaggtcatcatcatcgacgagttcaccggccgcatgatggaaggccgccgctattccgagggcctgcatcaggccctggaggccaaggaaggcgtgaccatccagaacgagaaccagaccctggcctcgatcaccttccagaactatttccgcctgtaccccaagctggccggcatgaccggcaccgccatgaccgaggccggcgaattcgccgagatctacaacctcgaagtggtcgagattcccactaatctggcggtcagccgcaccgaccacgatgacgaggtctatcgcaccgccaaggaaaagtacgaagccatcgtcaccctgatcgaggaatgccgtggccgcatgcagccggtcctggtgggcaccacctccatcgagaagtccgagctgctctcggacatgctgaagaagaagaagatcccgcaccaggtgctgaacgcccgctatcacgagcaggaagcctatatcgtcgcccaggccggcgtgcccggcggcgtcaccatcgccaccaacatggccggtcgtggcaccgacattcagttgggcggcaacctggacatgcgcaccaggatggagctggccgacgtcaccgacccggccgagcgcgtcaagcgcattgagggcctgaaggccgaaatcgaggtcaacaagcagaaggtgcgcgagtccggcggcctttacgtggtcggttccgagcgccacgaatcccggcgcatcgacaaccagctgcgcggccgctcgggccgccagggcgatcccggcgcctccaagttcttcctgtcgctggaagacgacctgatgcgcatcttcggctcgcagcgcatggacggcatgctgcagaagctggggctcaaggacggcgaggccatcgtccatccctggatcaacaaggccctggaaaaggcccagcagaaggtcgaggcccgcaacttcgacatccgcaagaacctgctgaagttcgacgacgtgatgaacgaccagcgcaaggtcatctacgagcagcgtaaggacctgatgagcgccgacgacgtctcggaagagatcgtcgccttccgccacgaggtcatcgccgagatggtcgcccgctgcatccccgagcgcgcctatgccgaccagtgggatgtggcggccctgcacgaggaggttctgcgcgttttcaacctggacctgcccatcgccgaatggggcaaggaagaaggcatcgccgaccaggaaatccgcgaccgcatcaccgaccatgccgaccgcaaggcggcggccaaggtggccgaatacacccccgacaccatgcgcatggtggaaaagagcctgctgctgcagatcctcgatcaggcgtggaaggagcacctgctgcagctcgaccacctgcgtcagggcatctccctgcgcgcctacgcccagcgcgatccgctgaacgagtacaagcgcgaagccttcaacatgttcgagcagatgctgctcgacctgcgcgagcgcgtcacctcggtgctggcccatgtccagctccgcttctccagcgaggaggaggccgagcaggccctggagccccagcgccccgcccgcacccaggaaacccgcgaggaccccgccttctcctcaggcggcagcggggcccccttcgccctggctcagcgcaacaccgccgtcgaccccaacgacccggccacctgggccgccacgccgcgcaacgccccctgcccctgcggctcgggcaagaagttcaagcactgccacggggcggcttagggtatcaattcgggggcttttgcccccgatcccccgctcagggcgcgatcccccggtccctctttgattttatgaataaacaaaaagaggtttggagacatggtctccaagcggggtcggggcggcagccccgcctggcccggatcaaaggccttaaacctgcaccgtcgcggcgctcaggatgacgacgcgccccacatttgacgctcagtgtcctagctggcccggaccttggccacgaaatcctgcacgatccggcgcagggtatgcgcctcggccgccagttcggtggcagaggccaggaccgtggccgaggcctgaccggtatcgcgcgccgccgaggtgacgccggcgatattgcccgacaccgattgggtgccctgggccgcctcctccacgttgcgggcgatttcccgcgtggccgcgccctgctcctccaccgccgaggcaatggcggcggaaatctcgtcgatccggccgatggtggttccgaccccacggatggcatccaccgcccgccccgtctcagcctgcaccgaagcgatctgctgcgagatctcgtcggtggcccgcgccgtctgattggccaggttcttcacttcgcccgccaccacggcgaagcccttgcccgcctcgcccgcccgggccgcctcgatggtggcattcagcgccagcaggttggtctgggcggcaatatcggtgatcatggtgaccacttcgccgatccgcttggtggcctcggacaggccgtgaacgatggtgttggcctgggccgcctcgtccacggcgtcgcgggcgacgcgggcggattccgagacctgccggccgatctcggcgaccgaagccgccaattcctcggtggcggcggcaacggtctccacattggcggcggcatgctccgaggcgccggccacctcttccgcccggacggcgacctgctcggacagagtggacagcgcctgggccgtgtgctccatctcggccgaggccccggccaccttgtccaccacgaccgaaacgccgctttcgaagtcagcggccagggacttcatttcctgatgatgccgactttcggccagacgcttgttctcctgcgcctccgcctccagccggcctttttccagcgcattgagcttgaacacctggacggcgcgggcgatttccccaacctcgtcgccgcgatcctgcccggtcacctccacctgggtgtcattggcggccagacgccccatgaccgcgatgatgcggtgaatgggccgggccaccgagcggccgatcagcgccgacagggcgaagccgagaaccagaccaagtccgaccaggccaagactggcgctccgatcgcggtcgtagttctgctcgccctcggcgaacatggtggcggcttcccggctctggaaatccagcaatttgcgcaagggggtggccgcctcacggaatttatccacccccttgccgcccaccagatcggcaaggacgccgttggcttcgccggcggcgatgcgcgcccaactctcctgtataaagccctggtagctcttgatgccggtctctgcctcccgggccagggcggcttcctccggcgacaggcggctggcggcatacgcattccaggtcttgttcagatcggcgagctgcttgacgtattcatcgcgcagcgccgcaatgcgggcggaatcggtttccatagccgcgccgatcacgcggacgcggatgcggtgcagggcatccacggttcccgaaagatggatcaacgccggggtcgtatcttccgtcaccgcccgaaagccgtcgtgcatgcggctcatacccaggataccgaagccgctggtggcggtcaggagcagcagcatcaggacagtcatggcctgaagcttgcgggtgatcgtccaatgaaaactcatggctcacctttgatatacttcttttggactgcagcacccgaaccagccctatcatagctgggcgccacatctccatacctataataatagtggtgtataaaacatgaagttccataggccgccgccaaacgaaaaagggcgggaggccatggcctcccgccctgcgttccgtccggaaccgctgatttagcgggtcggaaccggggtctcgccggtgtaatcgtagaagccgcggccggtcttgcggcccagccagccggcctccacatacttcaccagcagcgggcaggggcgatacttggtgtcggcgaggccctcgtgcaggacctgcatcaccgccagacaggtgtccagaccgatgaagtcggccagttccagcggacccatggggtggttggcgcccagcttcatggcggtatcgatgctggccaccgagccgacgccctcgtacagggtgtagacggcttcgttgatcatgggcagcaggatgcggttgacgatgaaggccgggaagtcctcggcggccactgccttcttgcccagcttctgggtcatctcggtcaccagggagaaggtctcctcgctggtggcgatgccgcggatcaattccaccagcttcatgaccggcaccgggttcatgaagtgcatgcccatgaacttggcgggacggtcggtggcggcacccaggcgggtgatggacagcgacgaggtgttggacgcgatatgggcctcgggcttcagcaccgggcagagctgggcgaagatggcccgcttgatcttctcatcctcggtggcggcctcgatgaccagatcgctatccgagaaatcggcataggcggtggtggtcttgatgtgaccgagcgtggcagctttttcggcctcggtcagcttgcccttggaaagggcgcggtccaggttcttggtgatggtgccaagacccttcttcagggcctcctcgctgacgtcgagcaggataacgtcgaaaccggcggcagcgcagacttgggcgataccattgcccatctggcccgcgccgataacaccgatcttattgatagcagtcattatgaggctcccggatactatggcttcagccgtagggcaggttgacggttacttgttgagttcggaggccagctccggcaacaccttgaagagatccgcgaccagaccgtaatcggcgacctggaagatgggggcctcttcgtccttgttgatggcgacgatgaccttggagtccttcatgccggccaggtgctggatggcgcccgagatgccgacggcgatgtagaggtcgggggcgacgatcttgccggtctggcccacctggaagtcgttgggcacgaagccggcgtccacggcggcgcgcgaggcaccgactgcggcgcccagcttgtcggccacggcttccagcaggtggaagttgtcgcccgactgcatgccgcgaccgcccgagatgatgatccgggccgaggtcagttccggacgctcggacttggacagctggctgccgacgaaggacgacagggccggatcggcggcggccgacacggcttccaccgacgcggagccgccctcggccttggcggcctcaaagccggtgccgcgcacggtgatcaccttgaccgcgtccttggactgcacggtggccagggcgttgccggcatagatcggccgcacgaaggtatcgggcgacaccacggcggtgatctcggagatctgcgccacgtccagcagggcggcgacgcggggcgccacgttcttgccccccgtggtggccggcgccaggatgtgggaataggacccggcaaggctcaccaccagggcggccagcggctcggccagatggttggcgtaaagggcggcgtcggccgacagcaccttggcgacgcccgccaccttggcggcggcctcggccaccgcgccgatgcccgagccggccaccagcacatgcacgtcgccgccgatcttggaagcggcggaaacggtgttcagcgtggcggatttgagagcgccgccttcatgttccgcgataaccagaatggtcatgtcttttcgttccttgtcctggccacgtcggggcttccgccccgcaccccgaccggggaagaccccggaccccttttgaattcaaagggggtttggggcatcgccccaaatgggtccgggcaatcgcccggtcgtgccgtcagatcaccttggcttcgttcttcagcttgtcgaccagggcggccacgtcggccaccttgatgccggcgctgcgcttgggcggctcggccaccgacagcgtcactaggcgcggcgccacgtcgacgcccagatcggccggcgacaccgtgtcgatgggcttcttcttggccttcatgatgttgggcagcgaggcatagcgcggctcgttgaggcgcaggtcggtggtcaccaccgccggcagcttcagcgacaccgtctccagcccgccgtccacctcgcgggtgacggtgatggcatcggcgccgatctccaccttgctggcgaaggtgccctgggcacagcccagcagcgccgccagcatctggccggtctggttggaatcgtcgtcgatggcctgcttgcccaggatgatcagcccgggagcctccttggccaccagcgccttcaagaccttggccacgcccaggggctggacctcgtcatcggtctggaccagcacgccgcggtcggcgcccatggccagcgccgtgcgcagcgtctccgacgcggcggccgggccgatggagaccaccaccacttccgtggccttgcccgcttccttgaggcgaaccgcctcctcaaccgcgatctcgtcgaacgggttcatggagaacttcacgttctgggtctcgacgcccgaaccgtccgacttcacccgaatcttcacgttgtaatcgatcacacgcttgatcgcgaccaggattttcatcgtgtcttcaaccccttagaccccagagcggcccattaatcggcatcgccgggcggaatttgctattgcattgcacaatatgacgggagttcagggatgtcaacgcgcaccccccggcacccacaggacgtcttcagccccgttgccgttggcgacgcgggccaggacgaacagcagatccgacaggcgattggcgtagatgatcgcctggggattgaccgcctcgacatcggacagggcgaccatcaggcgctcggcgcggcgcaccaccgtgcgggcgtggtgcagatgggcggcgagcggcgagccggcgggcaggatgaacgaggcgagcggcgccagggactcattggccgcatcaatctcggcctccaggcgatccacctgggattggacgacgcgcaggcgcgtcccggggacctcgtcggcggcggcgggagtgcaaaggtccgcgcccaggtcgaacaggtcgttctgcaccctttgcagcagcgccatcatcgcgccctcggcgtgcaggcgggccaggccgacgaccgcattggcctcgtccaccgtgccgtaggcctcaacccgaagatcgtgcttgcccacccgggtgccgtcgcccagtgaggtcttgcccttgtcgcccgaccgggtatagatgcgcgtcagggtcaccatcgccgtctttccttttccaagccgaaaaggtttatgacacggagacgggcgaaacctctatactcggctttcctcggaccacaccgaattcgggcatcatgcgcttatcccccatcatgagcggctatatcgggcggcaattcgcctcggccttcgccaccgtcctgctggtgattctggggatcatcctgctgttcgacgtgatcgagctgatccgccgcgccgccggacggccggaactgggcatcacccccattctgctgatggcgttcttcaagctgccgcagatgctgcataccatcctgcccttcgcggtgatgatcggctccatggtgtgcttctggcgcctgacccgcacccatgaactggtggtggcccgcgccgccggcatttccgtctggcagttcatcacgccggtgctggccgtggccggaattttcggcatcttcgagatcaccaccttcaaccccatggccgccgccatgtacggccgctatgaacgtctgcaggacgaattgctggcgaccaaggccagcgccttcgacatttcagaggtggggctgtggctgcgcgagccccacgagaacggcgagatggtggtccactccgagacggtgcgccaggatgggctggtcctccacatccgcgatgcgcatttcttcctgtacgaccggcccgaccacttccaccagcgcatttccgccgaatccgccaccctggtggacggcgccttcgaggtgcggcgggcctgggtgatggaaggcggcaagccctcggtcttcaaggaacagatgcacattcccacccaactgaccctggaccgcatccacgataatttcgcgtcgccggaaaccctgtccttctggcaattgcccggcttcatccggttcttcgagcgagcgggcttcaccgccaacaagcatcgtctgtatctgcagtcgctgctggcctcaccggtgctctattgcggcatggtcctgatggcggcggtgttttcgttgcgacccaacacccggtccggcggcctgctggcccgcatcggcgccggcgtggccgccggtttcgccgtctacttcttttccaaggtgatctatgccctgggcctgtcggcgaccctgccccagactctggcggcctggacgccgccgctgttcgccggactgatcggcttgtcaggactgttccatctcgaggacggctgatggggtcagccgtgttccgcaatccctggacctgggtccttgccgccctggtgccgctgacgctgtttccccagatcgaccttgccgcctcggcgctgttcttcgacgcccaggcgcgcggctttccctttcgcgttcaccccatcggcgaattcgcccgcaagattctgcccatcttcctgttcaccgccgccgggctgatcgccctggccggagcggcggcggcgattctcaagcgtccggtggcgggcatccggccgcccatggcgctgctggtagtgggctccctggcgctggggccgggcctggtggtcaatgtcattctcaaggattactgggggcgggcgcgcccctcgaccatcgccgaattcaacgccggccaccagcccgaccgccgctacaccccgccgctgattatctccgaccagtgccccgacaattgctctttcccatcgggccacgccgccctgggcttttggaccgtatcgctggccctgatcgccccgccccgccgccgccgcgccgcctttgccgccgccctggccttcgggctggccatgggagcggtcagaatcgctcaaggcgggcattttctgtcggatgtcgcctattcgggcgcaatcgtcgtcggcctgaccatggggttgtaccggattattcgccgccacgaccgcagtgcagcacaaaaaaataattatcaggagcccttgcgcggcccgtaaccccctatgcgggcgcctgattctcaggtaatgatatagcttcaggctgaccttggcgcgctgagccgggcggaatgccctcgcgtgggtgcgggggattttgtttacttacgacgagaatgacacatggcatggaaccgagataatcatggcaggggcgagcgcggacgcggtcgtcgggacgactttggcgagccggctttcgacccgcgtccttcgcggccgatggcgcccagctcctttgaccgtcagatggtcagtcaggcgaacgtcagcgccactgtgaagtggttcaatgcctcgaagggcttcggcttcgtcgccccgtccgacggcagccccgacgctttcctgcacatttccgctctcgagcgcgccggcctgacccaggtcgccgaaggcgcgaccctggtggtcgacctgggcgccgggcagcgtggcccgcaggtggtgatggtccatgaagtggacagcaccaccgccaccccgcgcgccccgcgccgggaagagcgcggcccgaccgagaccgtggagggcgtggtcaagttcttctccgccgagaagggctttggcttcgtcgcttgcgatcagggcggcaaggacgtgttcgtgcacgtgaaggcgctggagcgctccgggatcaagaccctggaatccggtcagcgcgtccgcgtcaccaccaccctggggctgaagggcccgcaggcggataccgtcgcgatcatctaggtcgtaggacccaggccctcccctctcggcggggggcctggaacgacccggatgaatttttgttgacctgaattctgcattctggtaccacaatgctcattactgctttgtctccctgacattgggcgggacgcggcgatgagccgggtcccgccacttttttgcccgccccggaattcggggcctgggacgcgccgggcgggcgatgctgcattgcacaaaatcctatcgcattccgcccccgattcggtgcagactagccgtcaggcaatgcatgccgaggaacgagaatgctgggacccgcggaacttcgcgaaatttacgactgcctcaagggcatgggactggagccagtgcgcgtcgccgatggccgcagcccctacctcaaccccgccttcgccgccggcatggcgatgaccaaggccgtgcgcggcaaagccgccaccctgcccgccaagaccacccccgagccgaccgagaccaagtaagacctgggtgcgggagtctctgttgggcactcgcccaaacccatccggggcatgccccggccccccttttattttcaaaaccaggggaggtttggaggctcgcctccaaccggggctaaggggcgggagccccgcctcgccgtgccgacgccgtcatagacagcttttcagcccctcgcgataggtcgggtatttcagccggacgcccaggtcgcgcttcatccgggcgttgtcgacgcgcttgttgtcggcatagaagctgagcgccatgggcgacagggtcgcctcggcctgctcccacggaatttccggcggcggttcgaggcccagcagggcgcaggcgtgggcgatgacctcctggggcggggcggcgtcatcgtcgcacagattgtagatcgccccgggatcgggacgccccagcgaggccagaatcgcggcggcgatgtcctccacatggatccgactgaacacctggcccggcttgaccacgcgacgcgcctgcccggcccgcacggtgtccaccgccgaacggccggggccgtaaattcccgccagccggaagatatgcgcccccctctctcgccactgggtttcggcggccagacgacggcgcgagcggtccaggccgggattgggcggcgtcgcctcgtccacccaggcaccgccatgatcgccgtagacgccggtggtggagagatagccgagccaggcgggagccgccgcgcggatggcgtcggccatcaggtcgagcacggggtcgccgcgatcatcgggcggcaccgaggacagcaccgcctcgactccgtccagacagccggccggcagacgatggtcgcggtcgaagggcagaacctggaccccgggacagtccgccgcctcgcccgagcgggtggtggccatcacctcccagcccgcctcgaccagcccgcgggcgatcacccggccggaaaagcccagcccgaacaggaaaaatcgcttggccatctgtctttccttgcaccgcccgcacaattggagagactacgcccccatgagactacgcaccatccccctgctgctgcccctgctgtggcttcccgccccggctccggccgagaccatcaatcccaagatggaataccgcacctgcctgaccctggcccgcgccaagcccgaggacgggtgggaggaagccatcgcctggggctcgctgggcggcggcgagccggcgcggcactgcgcggcggtggcgctgatcggcctgggcaagtacgaagaggccgccaaacgcctggaagccctggccggcatcagccgccgcgaggaatcgctgcgcgccgagatgctggcccaggcgggacaggcctggttgctggcgggcaagccgcagctggcactggccgaccaggacacggcgctgaagctggtgccgggccaccccgagctgatgctggacaaggcggtcaccctggcctcggtcggccattacgccgaagtggtcgacgtgctgtcggccctgctcaaggtgcagcccaaccgcatcgaggccatggtgctgcgggccgtggcctaccgctatctggacaagctggccctggccaaggatgacctggcccgcgccctaatcctggaccagtcctttcccgatgccctgctggaacgaggcatgatccgccgcctggaagacgatcaggccggcgcccgcgaggattggatgaagaccatcgccgccgcgccggaaagtgccgccgccgacacggcccggcgcaacctggagatcatggacgtcaaggtgaaatagattacctcggattgtatacgtaaaaattgtcgattcaactgagtgcaattagcgcattgccgtcaatctttggcagcaatacccttaccccatgaagcaagggggcgcggcctcctgaaaagtggggaggacgacatggcgcagaatttctttctcaggctcgcggatatcgacggcgagtgccagatcacgggtcacgcgaaggagattcaggcgctgtcctggagccactccttcaaccagcccaccagcccgacccgctcggccggcggcacggtggagcaggccaatcacgccgatttcagcttcaccaaatacaccgacgcggcctcggtgcccatgctgaagcgatgctggagcggcaagcccatcgccacggcggtgttcaccgcctgccgctcggatggcgacgccctggtggaatacctgaaggtggaaatgagcaacgcgatcatttccaacgtctcgctgggcggcggcgccggggacatgccggtcgagaccgtgaccctgtcctacagcgcggtccggtacacctacgccttccaggcgacgcccggcagccggacgacgccgttgtcgagcaagcacgacatcgccctgatgaaggtggagtagcgcccccggctcggagcacgccgcgtcgacaggttggggaaaacctcacttcgggggctttccgcagccagctaaagccgccgggcgtcctcgtccggagtcatcagggtcagcgccatggcgtgcacgcgcccggccagctcctcggccagcagggcgttgaccttgcggtggcgctcgacgcggctgacgccttcgaaggccgccgagacgatggtcacggtgaaatggctttccccgtccggatgatggccggcatggccggcgtgccggtgggaatcatcggccaccaccagccgcgtcggcttcagcgcgtcttcgatcttctgcgtcatgatctcggccaccagcattcccgtaatccctctcgtgaaatcgaaccctccccaattggggccaaaggggcccggcgtcaagaggaggttccgacagcccatatgcgccgctcacgccttgccttggcgcgggcgagcctccattatgaccggtgccatgaaagcgaccaacgcccgcagatcctggcggccggccttcggcccctccccggcgcaaccggccacccgccgttgcgaccatcccggctgcgcgctcgaagccgaatatcgcgccccccaggcccgcgaccgactgaccgattactactggttctgcctgaaccatgtgcgcgagtacaatctggcctggaactactacgccggcatgggcgccgaggagatcgaggccgaactgcgcaaggacaccacctggcagcgccccacctggccgctgggcatccagggcgccaagcgcaaattcgcctataccatccacgaccccttcgaggttttcgaggacgccgccaccgaggaggcgcggcccaaggcccgcgtcgccacgcccgaggaagaggccatggcggttctcgaactgactccgccgctcaccgccgacatgctgaaggcccgctacaaggaactggtcaagcagcatcatcccgacgccaacaatggcgacaaggacgccgaagagcgcttcaagcgcatcaaccacgcctacaacaccttaaagctcagcctgagccagtaagcagccccccaaggacgagagtatgacctccaagatccaaagcccgcttgcctccgaccatcccctggccatgcccgataccgagatctccgcccgcgaggtgttcggcatcgacctcgacatgaaggttcccgccttctcggtaggcagcgagcacgtgcccgacgtggacccggcctaccgcttcgacccggacaccaccaaggccatcctggccggcttcgccttcaaccgccgcgtcatggtccagggctatcacggcaccggcaagtccacccatatcgagcaggtggcggcacggctcaactggccctgcatccgcgtcaacctggacagccatgtcagccgcatcgacctgatcggcaaggacgccatcgtggtcaaggacggcaagcagatcaccgaattccgcgaaggcatgctgccctgggccttgcagcacccctgcgccctggtgttcgacgaatacgacgccggccgccccgacgtgatgttcgtgattcagcgcgtgctggaagtggaaggccgcctgacccttctggaccagaaccgggtgatccggccccacgccgccttccgcctgttcgccaccgccaacaccgtgggcctgggcgacaccaccggcctctatcacggcacccagcagatcaaccagggccagatggaccgttggaacatcgtcgccaccctgaactatctggcccatgacgacgaatgctccatcgtggtggccaagctcaaggattacgacagccccgagggccgcgacctggtgtccaagatggtgatgctggccgacctgacccgccagggcttcatgaacggcgacatctccacggtgatgagcccgcgcacggtgatcacctgggccgagaacgcccgcatcttcggtgaccattcctatgccttccgcgtgaccttcctcaacaagtgcgacgaggtcgaacggccgatcctggccgagtactaccagcgctgcttcggcaccgacctgcccgacggtcccgcccgcatgctggcttaaaggagcggaccagatcgtgtcacagaacgcgacggccaaggatagcggcaggggcgaaagcatcggcgagaccatccgccgcgccaccgccgcgaccttgaaggccatgtcgggccacgcggacctggacgtcggctatgccgccggaaacggcagcgtgcgcggcaccgagatccggctgccggcgccaccgcgcaacatcttgccgtcggacctggcccgcctgcgcggcaccgccgacgccgtcgcgctccggctgcgctatcacgacgacacggtgcatgtgcggcgcatgccgcaactgcccgaggcccgcaagatctacgacatggtcgagcaggcccgggtcgaggccctgggcgcccgcctgatgcccggtgccgccgccaacatcgccgaggtgctggaggtcaaggcccgcgccgaggggctcgaccgcgccgtcaagcgcgagcaggtggccctggccgacgccatgcgcttcatcgcccgcgagatcttcgccgggctggaaccgccgccctcggcccgcccggccgtcgacctatggcgcgacgaggtccgggccaaggccggtccgacgctggacgctctcaaggatctcctgcgcgaccaggaggcctttgccaagggcctgcacaggctgctgagcgacctggatttcggcaccgatcaggcctccgaagccgaggactccgagaattccgagcaaagcggccaggagcaggacgcccagggcgccggccaggaaaaggaaggcgagcaggagggccagggaccgcagcaggaaggcgacacccaggcgccgggctcgagcgagggcagcggcgaggacgacggcaccgattccggcgaggagatgatgctgaccggctcgggcaccgaggaaccgggcggcccctccaagcaagcccaggaacagctgtccaattccgccgccttccaggaccggccctacaagccctacaccacccaatacgaccagatcgtcaccgccgaggatctgtgcgagcccgaggagctgaaccgcctgcggcgccagctggaccagcaactgacccacctgcagggcgtggtcgccaagctggccaaccgcctgcagcgcaagctgatggcccagcagacccgcaattgggatttcgacctggaggagggcatgctcgacaccgggcgcctggcccgcatcgtcgccaatcccatgcactcgctgtccttcaagatcgagaaggaaaccaatttccgcgacacggtggtcagcctgctgatcgacaattccggctccatgcgcgggcggcccatcaccgtggcggccatgagcgccgatctgctggcccgcaccctggagcgctgcggcgtcaaggtggaggtcctgggcttcaccaccagggcgtggaagggcggctcggcccgcgagaagtggcaggccgagggcaagccgaccaatcccggccgcctcaacgatctgcgccacatcgtctacaaggcggccgacgccccctggcgccgggtgcggcgcaatctggggctgatgctgcgcgaaggcatcctgaaggagaacatcgacggcgaagccctgatgtgggcccatgaccgcctgatctcgcgctcggaacagcggcgcatcctgatggtgatctcggacggggcgccggtggacgattccaccttgtcggccaatcccggcaacaccctggaaaagcacctgcgcgacgtcatcgccttcatcgagaaccgctcgccggtggaactggtggccatcggcatcggccatgacgtcacccgctattaccggcgcgccgtcaccatcatggatgccgaggacctgggcggcaccatgatgcgccagctgaccgccctgttcgacgacgaggccgagcccgcgggcggccgccgccgggcaagatgatcatgaacggcggccgcgtggatatctcgcaatccagccgcctggacaagccgtccgaagccgttcagtcgtcgcggctgcctcggccccggctgctgctggccatgatcgtggccatcgccgtgctgggcggcatggccgggctggcgacgctgacctggttcgatcaccaggcgaccctggacgactggagcgccaatctccggctgtcggcccatctggtggaatcccatacccgcgccgcccacggcaccgtccacgcccatctcggcacggtgatcggccgggtgggaggcaagcccctggccgcgctacgctcgtcgcgccaggaccgggactggctggagaccttgctgaccgaattgccccacggggttgccatcgccattcacgacgagcggggcgacccggtactggtgaccgaccgccttggccttttttccgccaacgccagtcaccgcgactatttcatcctggccatggggcagcccggacgcacggtgatgagcgccgtggtccccggacgcggcgatcaggggcgggccatcatcttcagccgtgccatcctcgacgccgccggacgcccgcagggcgtcgcggaaatcgcgctgaaaaccgactatttcatcgagttctaccggagtctgcagtcagagccgggggccatcttcctggtgtcgcgcctggacggcgggctggtcgcccgctatcccctgccagacgccaccttcacccgcttcgacacctcgaaacacccctttacggaattcgccaaggggcagtccggcatctaccgctccacctcggtggttgacggcatcgaacggctggtggcctaccgcaacctcgccgacctggagatggttgtcacctcgggtatcccgaccaaggtggtgttccgcgaatggacggtgcgcagccgacgcaatgcgctgctgttcgtcaccgccatggtgctgatgctggtgctggccgccatcaccagcgaaagcctgagacacgaggcccggctgctggccaccggagagcgccgcacccgcgacctgaccaccgccctggcggaaaaggacgttctgttccaggaggtccatcaccgggttaagaacaatcttcaggtcatctccagcctgttgaccatgcaatcgctgcacgtcaccgacgagaaggtgaaggagaccctgaaggacgccctggaccgcatccattccatgggcctggtgcaccagaccctctacgagcgcaatctggcctccaacgtggacctgggcacctatttcggcaagctggccgaggccctggccgggtcctatgcctcgtcaccgggcggcgtcaccgtcgaggtcgaggtggagggcaccctggacctggagcgcgccgtgccgctgggcatgctggccaacgaggtgctgtccaacgccatgaagcacgccttctccgacggacggcgcggcaccatctgggtgaccctggtgcgcgaggcgggcgagtggcacttcacggtgcgcgacaacggcgtgggcatgcccgacaagccgggacgcggcatcggcatcggcctgatccgcgccctgtcgcgccagctgggcggccgctcccacatcttcgtcgacgagggcacggtggtctcggtcaccttcccggcgtaacctttcgggaaaagtgggcttggggcggcccggcgcccacttttcgactctttgtgttctatttcttgggccggaacgccttgcacaccgccgggtcggtatcgatgaaggcgccgccgatcaggtcgatgcaatagggcacagccggcatcaccgcgttcaggcaatcggcgatggccgagggcttgcccggcaggttgatgatcaggctgtggccccgaatgcccgccgtctggcgcgacaggatggcggtggggaccaccttcaggctttcggtgcgcatcagctcgccgaagcccggcatcatcttgtcgcatacggcctcggtggcctcgggcgtcacgtcgcggggcgccgggccggtgccgccggtggtgacgatcagcgaacagccctccacgtcggccagttccttcaaggtcgcctcgatcaccgcctgctcgtcctcgatgacccgcgccaccggccgccagggcgtggacaggaagcgggtcatctcggcgacgatggccgggccgcccttgtcctcgtagatcccccggctggcgcggtccgagatggtgacgaccccgatggggacgggctgttcggtcatggcgtctttctcctggaaaaggatcacggagtgtgatgacctcggcgaaacgggtcaagagcacgagggcatgatgatcatcaccaccaccgattccgtcgaggacaagcgcatcaccggctatctcggcatcgtcagcggcagcgcggtgatgggcaccaacatcttccgcgacatgctggccagcgtgcgcgacatcgtcggcggccgctcgggctcctacgaggccatcctgcgcgaggccaaggacgcggcgctcgccgatctccaggcccaggccgcccagttgggcgccgacgccgtggtggcggtggacctggattacgaaaccatcggcggcgatggcaagaccatgctgatcgtctcggccaatggcacggcggtcaagctcggttaacgacaaattaagaatcacaacgggttccagggtatcgttgagatattccgtgacttttcggccgtaattgcgctagatgattggattctaggttctgcggatgagcagccgtgtcttgtcgtcttgtcttcgcggttctgaccttggccttgctgggcgcctgctcctcgccgccgccccggcccgccccgccgcccgtccttgatcccgattccgcctgcctgcaggatctgcgcaaccaccatgtggtgttcgagacccaggcgccgttcggcaccgccggaacatgctcggtgggcaatccggtcaaggtcagcgccgattcccagacctcgtggaatcgccccggcctgatgtcatgctccatggcgcgcaccgtcgaccgcttcgagacccaggtggtccaggccgccgcccagcgcattttcggccagaaggtggccagactccaccatatgggcacctataactgccgcacgcggcgcaccgagaccacggtggccgccgccgacatgggcagccggggcggccgcctgtccgaacacggcaagggccaggctatcgacgtgggcggcttcgaactggccgacggcaccatgatctcggtgaagaaggactggcggggcgccggcaagaagagcgagtttctccaggcggtggcccgggcctcgtgcgagcacttcaacgtggtgctgacccccaaccacaacaggctgcacgccgaccacctgcacctggacatcggcccgcacaagctttgcggcatttgaggacctcgccgtgaccgccgttcccgcaccgccgccgcttcccctgctgctcggatggccggccatgatcgggcttgccgccctgaccctgaccaccatgggtcccaccggcatcctgcttggcggcctgctgttcgccgccgatcggttgagcggcgtgctcatgcccgctctgatggtggccggagccgtgtcgtcggtgctgttctaccccatggtggccgtcttcttcctgcgccgccgatggccccggttttccctggccgtccagtggggacaactggcaagcggagcggtgttctggctgctgtggttcgccgccgaccggctgtgcggcctgtccttcgtctgtctctaaaggaaccatcccgtgaccagaacctgcccggaatgcggccacggcgacatccgcctggaacccgaaaaacggccgcaaatcgatatggccccgtcactgggggagagcttggccgggacgcccatcccactgccgggggtcgatctggttctgaccggcatcggcctggcggtggaggcggccggctcgctgtgcgaggccttgggtacggcggtcaaacccgccgagacgcccgccatggtggcctattgcccccaatgcggctggtgggaagcggccacgacggagaccccgccgcgaccctgatcccgggtgacctcacagcaccgtcagcatgctggccaccagcgggtggcggacgatgtccttttcgtcgagggtgaccaccgccacgtcgggcagttccgacagccgcgccgcgatgtcggccaggccggacatgccgggcagcaggtcgctctggtccgggtcgccggtcagcaccatggtggaatgccagcccaggcgggtcagcagcatcttgatctggccataggtgcagttctgcgcctcgtcgatgacgatgaaggcgttgttcagggtgcggccgcgcatataggcgatgggagcgatctcgatggagccgtcggccagcagggcgcgcagccgcttgccgcccaggcggtccgacagggcgtcgtagagggggcgcaggtatggcgccagcttctcctgcaggtcgccgggcaggaagcccagggattcccccgcctccaccgccgggcgcgacagcatgatgcgcgccacccgtccctcctcgaaggcttccaccgccgccgaaatggccagataggtcttgccggtgcccgccggccccagggccaccgtcaggttgccgtcgccgatggccttgagcaggcggcgctggttgtcgctttgggggcggaccttgcgcacatagctttgctcacggtgctgatcgtcgtcgcccagcgggctccaggtctgctcggcgggataaagcgacaccaccggctcattcttcgacgcggcaatccgcgctgcgcgcttggccatctgagactcctgtggaaaggcagagggaaggtggcaacaaaaaagggcctctcgacacgagagacccttggaaggagaggcggacttcgctgcggcccgcaagcggcgggcgaccctgtcccgaaaaacagcccagtgctcggtccaagcagcgaatcaacgggaattcctccgtccgcgatcacaacccgcacaaaccttaatcaacggcgagtccgcttgtcgacaacaaatcgtccccgtcacggcattgtaataccatatgtggagttaacgggatgtgaacggattcactcagccccctgcgggcaggatgcccgccctttcaggtcaccgatggagcgggggccggcggcatcacccggatggaggtgatctggttgcgctggcgccgggcgatctcgaagcggaagccgtagaagcggaagacctggcccacatcgggaatctgccgggcctcgtgcaggatcaggccggcgatggtggcggcctcctcgtcgggcaggcgccattcaaattcgcggttcaggtcgcggatggtcaccgaaccgtcgacgatataggaaccgtccgactgggggcgcacaccggccaccgccacgtcgtgctcgtcggcgatatcgccgacgatctcctccaggatgtcttccagggtgaccacccccatcagggtgccgtactcgtccaccaccagggcgaaatgctcgcgccgcgaccggaaggcctgcaactgctcgagcagcgtggtggaatcgggaatgaaccaggggggcgaggccagttcgaccacgtccagcttgtccagctcgccatccagggcgcggacggcgcgcagcaggtccttggcgtggaccacgccgacgatgttgtcgggatcgtccttccacagcggcacgcgcgagaagggcgagctgaccaccagttccaggatctcggcggcgggcaggccggcatcggcggtgaccacgccgcgccggtgggtcatcacctgctccacttccacgtcgcccagttccaggatcgagcgcagcatgcggcgctcctcgcgcacctcctcctcgccggcatgaacctcgatggcgcctttcagctccatcatggaggcctcgacgctgaccgcggtggagtacttggcgccgaacaggcggaacagccccatgaccaccacctcgacggtgcgcacgaagggggtcagaatccacaccacgccggtgaccggcgcggagaacagcaaggccatgcgattggcgtggtagatggcgtaggtcttgggcagcacctcgccgaacaccacgatgatcaccgtcatgccggccgaggcataggcgatgccggcgtcgccgaacaggccgaccagcacgccggtggccagcgacgacgacagggtatgggtgaggctgttgccgatcagcagggcgccgatcagccgctggcgggcatcgatcagacggttgacccgccgggcgggggcactgccgtcctgctccaactggtgcatgaccgggcgcgacacggcggtcagcgccgtctcggtgccggcgaagaacgccgaaccggcctgcagcaccacgatggcaatcactgaaagggtcaggaagagaggcccttggtccaacatcgccttatccccttgattgcccctgccgggtgcgcaccgctctaataccccgacgccatctccgccagcatggaggccagctcggcttccggcacgtcgcgggtcaggaagctcttgccgatgcccttggccatcacgaaggtgaccttgccgtccttgaccttcttgtcgccggccatgtggtgaatcagccggtccaccgcccacagccggggcttgggcagggtgacgggcagccccaccgccagcaggtgacgctccagccgctcggcgtcggccgcgggggccagccccaggcgggccgacaggcgcagcgccatgaccatgccgatggccaccgcctcgccgtgcagcatctcctcggagaagccggtctcggcctccagggcatggccgaaggtgtggccgagattgagcagggcgcgcacgccgccctcgcgctcgtcggcgccgacgatgcgggccttggcgcggcacgaggtggcgacggcgtaacgccgggcctccaggtcgccgtccaccactttggacccgttctcctccagccaggcgaagaacggttcgtcgtcgatcaccccgtacttggccacctcggcatagccggccagcacctgccgccggggcagggtgttgagcacgctggtgtcggccagcaccagccggggctggtagaagctgccgatcaggttcttgccctggcgggtgttgatgccggtcttgccgcccaccgaggaatccacctgggacagcaaggtggtggggatctgcacgaaatccacgccgcgcagcaggatcgaggcggcaaagccggtgaggtcgcccaccacgccgccgccgagggccaccaccatgatgccgcgctcggagcgggcttccagcatggcgtccagcagggcttccagatgcttgaagtccttggtctgctcgccggcgggcatgaccgtatgcatggtggtcaccccggcctcggccaggctcttctgcacccgctctagataatggggcgccacgttggcgtcggtcaccaccagggcgcggccgccccgcatcttcggcttgatcagctcgcccgcccggtccagcaggccggggccgatatggatcggatacgagcgctcgcccagttcgaccatgacctcttcggcggcggcactcatacggtcttctccagatccagataggtgatcagcccctccatgacgcggatcacggtggcttcggggacttcgtcggtggactcgacgataatgtcggcttcggcatagatgggatagcgggcttccatcaaccggccgagaatttcacgggggtcgccctgctttagcagcggacggtggtcgcggcccacggtccgcttcagcaaaagctcgagatcggcgcggatccacaccgaggtcccggcggccttgatgcgctcgcgggtggtggggtcgacaaaggctccgccgcccgtggccaggaccaccggcgggccgtccagcaggcgggcgatgaccttgcgctcgccctcgcggaaagcggcctcgccgaagcgggcgaagtagtcgctgatgctgctgcccgaggcggcctcgaactcggcgtcggaatcgacgaagtccagccccagacgggcggcgaggcggcggccgacgcaggacttgcccgcgcccatcaggccgaccaggacgatcgtgcggccgatccgccctgacagcagcggcgccagtctcgccagttcgtcggccatgccctgatccaaggttggtcccgctccttgaagtttaaaaaaaccggcgagccggcgttgatcaccgtcgccttggccgatacactgcccgcacgtacgcatacggggccgtacctgccgcttttagccgcaccccaccggtcctgtccagaaatgttgccattacgaggtcatccgtcccccatgaacaagattgccggccttcttgttgccctgctgctggcggttatcgtcggcggcggattgttcctgtccacctgggacccgccgcccccgtcggcaaagatcgagaaggtcataccggatgcccgcttcccgcgctaacgccctggccctggccgtgggcgccgtctttctggcggcccccgtgctcgcccccgccgcctgggcggagcagccgggcaagccgctgatcctcacctcgcccaatgccgagcccgagcataaggccgagcccgagcataaggcggaacccttggccgaggccgccccggcggcgcgggccgagttccccggcggcccggccaagcccggcccccgtttcgaggtcgaggagctgaaggctcccgatcccgatgccgtgggcgtcctcgacgaaagccagggcggattgggccaggccatgtggcacggcacccccgccgccaccgtgcgcaaggtgctgcccgccctgcccgccgccgccggttcacgggccgtccatgccctgtcgcgccgcctgctgctgtcggccgccaccgcgccggacggcaatcgcggccagtcgccctccctgctggaactgcgcgccgaacgcctgttcgccatgggcgagatcgacgggctgtcggctttgctcaaggccgctccggcggtggtgtcctcgcccggcctgtcgcgtctcaaggtcgacacctggctgctggccggcgacgccaaggccgcctgcgccgaggcccccatcatggcccagggcgccgccctggacccccgcctgtccatcttctgccagatcaccgccggcaagggcctggaagccggcatggcgctggacatgctgcgcgagcgcaaagacgccgaccacgccttcatcgccgccgccgaagccatgggcggcacgccgcccggcaaggtggacaagctgcccaatcccacgccgctgcatctggccgccttcaaggccgccaagctgccgctgccagccgatacggtggccaatgcgccgccctccatgctgcgcgccatcgccgacaatcccgccgtggccgtggacctccgcatcgccgccgccgagcgggccgaggcgctgggcgtcatggacaccgatgcgctgcgcaagctgatgaccggggcgagcctcaccccggcggaacagcaggcggccggaacccagggcgacaaatctcccaagggtcgcgccctgtggctgcgcgccgccggggccgaagccgcccccaatgtgcgggccgaactgttcgcccgcatcctgctggccgcgaccgagcgccacgccttctcggccacggcccggctttacgccccgctgatcgccgatctgaagccctcgcccgagatggccacgccgtcgcccatgctggcccgcgccctctacgccgccggacggcccgaggcggccggacactggctggccctggccaaatccgatccgaccacggccaagctggccgccgggttgtggcccctggcccgcctgtcccgcgtcggtctcgacgccagccccggcgattccttcgccgcctgggccgaaaccgcccagtccgacgaacgccgcaccgtggtcaccctggccatgctgcaggcggtgggagagcccgtgcccgcctcggcctggctggcccatgccaccggcaccgccgtgggcagtggccccaagccggccatgaaggccctgctgcgcgccgccgccgagggagcccgccgcgccgagacggtgctgatggccgccgccgccctgggcgagaccgggctggacagcgccgatcccgacatcctcaaccgggtggtggtctatctgcgtcaggccggatttgagcgcgaggcccgggaactggccatcgaagcggtgctggccaacggcggatgagcgtccccttcgaccgacacatcgagtcctttctcgagatgatgcaggtcgaacggggcgccagccccaacaccctggatgcctatggccgcgacttggcggatttcgccgaattcctggacgggcgcgggttcagcccactgagggccgacgcccgggcggtcgccgcctatatcgcccgtcaggccgagatcggcatggcggcccgcacccaggcgcgccgcctgtcctgcctgaagcagttctacggcttcgtcttcgccgagcgcctgcgccccgacgaccccaccgccaatatcgacgcgccgcgcctgggccgccccctgcccaaatatctgcgccgcgaggaggtgacggcgctgctggacgccgcccgcgccctggagggcagcgacggcatcctgatgaccgccctgctggagaccctctacgccgccgggctgcgcgtttcggaactggtctccctgccgctctccgccgtggcccgcgacccctcggtgctggtggtgcgcggcaagggatcgaaggagcgcatggtgccgctgtccgatccggcccgtgccgccctgctggcctggaaggtcgagcgccagaccctggtgcccaagtccaagccgtcgcgctggctgttcccgtcctcgggcgccctgggccacctgactcggtcgggcttcgccaagatgctgggccgcgtcgccgtcctggccggtctggaccccgccaaggtgtcgccccacgtgctgcgccattccttcgccagccacctgctggccgggggcgccgatctccgcagcgtgcaggagatgctgggccatgccgacatcgccaccaccgagatctacacccatctgatcgacgacgaagccggccgtctggtccgcgcccaccacccgcttgccgccaagccgggaaccaagccctaacccccccgcaaggagggcggctccgttgcaatcgttgattgccgcccttgtgatcagacggtaagcactaacacttattcccgtttcgttccgttgacatcccaaactcaagcgctgattctctaggcgttttcgggggatccaccctgtttccacggacgcccgttccacacgctccggttggggagagcacaggatatgacggacgacgagttcacggaggcattgcgccggctgggactgtcccaggctgccctggcccgcttgctcgacgatctgggcgagcagcagccggcccccaccacggtctggcgctgggccgacgggcggtctcgggttcccatcggcgtcggcgccctgttgcggctgctggagcaactgccgtccgagcttcgcaatcaggtcacccgcaaggcgctgcgggcctgacgccaaaagggccacccgagggtggccctttttcatttccgtgaacctgagttcggtctcaggccgcgttctcgcggccggggggcaactgcttgccgtagcgcttcatgtaaagcggcaggatcgcctcggccgaggtgggcgtgatacccagctcggtcaggcccggcttgccgccgcgcaccacgttgtccaccttcatcatccgcacctggtccttggtcagcatgggcttgggcagcatctgaaggaaggtggcctgcagcatgcccaggccgaagggcagcggcaccaacagacgctggcggccggtggacgacatcaccagttccatgatctccttcatggaatagcggcgcggcccgcccaattcgaaggtcttgccggcgtgacgggtgtcgtcgaggatctgcaccaccgcctgggccacgtcggagacgctgaccggctggaagatggggccgcccgagccgaacaggtcgatggagcacccggtctcgccgcagaccggcttgaagccgtcgccggtgaacaccggcagcaccggcgacaccatggccagcttgccgaagcgattgaagaaatcatcatcggggccgaacaccaccgagggacgcacgaccgaggcgccggggaaagcggccagaaccgcctcctcgcccgccgccttggagcgggcataggccgcctcggaattcttgtcggcgcccagcgcggacacatggaccagacgggccacgcccgccgccttggccgccgccgccacgttggccgcacccttcacatggatggcgtcgaaggtggcccggccgctctcatagagaatgcccaccgcattgaccaccgcatccacgccggcaacggccatggccaccgccttggggtcggtgatgtcggcgcgcagcggcgtcacctgccccacgtcacccatgggcttcagaaactcggccgcgatggggtcgcgcaccgcggcgcgcaccacccagccctgggcggccagacgcttgaccacgttcctgccgataaagcccgaaccaccgaataccgtgaccacgcgccgcgccatgcatccctccattcgccggacggcgccgcgcgccgcctccaaatctttggggcgaaagctagcccataagccacgcgggtgtaaagggcggggggcgaaaacacaaaaaccggaacggggtgaaaaaacaccgttgacaccgcccgccgcctcgcatatttcttcgcgcctcggacggctgaggcggttcgagagctacctgcccaggtggcggaattggtagacgcgcacggttcaggtccgtgtggcagtgatgtcgtggaagttcgagtcttctcctgggcaccatctcttaaccgcggcgcggtcctgtagatggatacatcggacgcggagccgccctccccaacaggggaaataaaggagcggctccgtgaccgttttctaccacaagaacgatctcccggacggtctcgaccttggcaatctcgttgccatcgattccgagaccatgggcctcaacctgcagcgcgaccgcctgtgcgtggtgcagctgtcggccggcgacggccacgcccatgtggtccattatcccaagcccgaatggaactcgcccaatctggtgcggatgctggccgattccaaggtcaccaagctgttccatttcgcccgcttcgacgtggccatgatccgtcgttacctgggggtgcgctgcacgccggtattctgcaccaagatcgcctccaagctgacccgcaccaataccgagggccacagcctcaaggtgttgtgcaaggaattcctcaacatcgacctgtccaagctgcagcaaagctcggactggggcgcgccggagctcaccgccgaccagctggcctatgccgcctcggacgtgctgtacctgcaccagctgaaggaccggctcgacgccctgctggaccgcgagggccgccgcgccctggccgaggcctgcttcgccttcctgcccgaccgcgccgagctggatctggccggctgggacgcggaagacatcttctcgcactgatatttcccccctcaggcgccgggcggggttctgcaccccccttggcttccgccgcatcagcggcgcggccccttgggcctagagagtgttttcgcccctcaggcgccgggagcacgccccccccggcctcctcgcgaatgcacaaaacggaccaagcggctccgttttgcctttccgtctttgggccgttgcgtatagttatgcgccctcgcctcgtggaagcggggaacggacctttttgaccggacccattgatgaccgccgattccgacgccctcgccattgcccgccgggttctcgacaccgaggcccgtgcgctggattccctggcggcaagccttgacggtccctttcttcaggcggtgaccctgatcgagcgggcgcccggccgcgtcatcgtcaccggcatgggcaagagcggccatgtggcgcgcaagatcgccgccaccatggcgtccaccggctgccccgccttctacgtccacccggccgaggccagccacggcgatctcggcatggtcacccgcgacgacgcggtggtggccctgtccaattccggcgagacgcccgagctgggcgacatcatcgcctataccaggcggttcgagatcgggctgatcggcatcacctcgcgccatggctcgaccctggccaccgcctcggacgtggccctggtgctgcccgccaatcccgaggcctgccccatggggctggcgccgaccacctcgaccaccatgatgctggccctgggcgatgccctggccgtcaccctgctggagcgcaagggcttcaccgccgccgatttcaaggtgttccaccccggcggccagttgggccagcgcctgctgaaggtcgccgacctgatgcatggcggcgatggcctgcccctggtgggcgccgaagcgaagatggccgaggtgctgctggtgatgaccgccaaaagcctgggctgcgccggcgtggtgaccccggacggccggctggccggaattctcaccgacggcgatctgcgccgccatatgagccccgatctgctgaccgccaaggccgccgaggtgatgaccgcctcgccccgcaccgtgccgcccaatctgctcgccgccgaggccctgcgccagatgaacgagcgctccatcaccagcctgttcgtggtggaaggcgacggccgcccggtgggcgtgctgcatgttcacgactgcctgcgggccgggctggcatgaccctgcgcgccgacacggattcccagcccgacaaagggcggcaccccacggggcgccatgcccgcgggccgcgtctcggccccttcgccgatcactcccacttcgtctcggtgatgaagatcgccctgcccgctttggccgttctgctgctgggcctggtggtgatctggcccaagctgtcgcagctggaaagcggcttcaagctgagcttcgccaacctgtcgcccaaatccgtcgacaccctggtgatgaagaacgcccgctatttcggcgtggacgagtccaaccggcccttcgcggtgacctcggacaccgccacccagatgcccggcaaccaggacctgatccatctggtcaatcccaaggccgatttcacctcgacctcgggcgccaatatcgtggtggacgccatcgccggcgtctatcatcagtccaccaaggtgctggacctgtcggggggcgtgaacctctaccacgacaccggctacgagattcacacgcccaccgccacggtggaactggccagcaacacggcgcggggctttgaaccggtggagggccacggcccccagggcgccatccgctccaccggcttcgagatcaccggcaagcaccacgacatcaccttcaccggcaagtcgcagctcaatctgcgcgccgtaagccacaaggcccaggacaagggccggagcaagggagccaagacgcgatgaagccgcccgctctttttccgctggttctcagccttgtgctggcggccctgcccggctccgccctggcccagggcttcgagatgagcaagtccggcgaccagcagatccaggtctacgccgataacggcatcgaatggcattccgaggaattgcgggtcatcgcgcgcggcaacgcccatgccatccgcggcaacatgaccgtggatgccgacgtgctgaccgcccattaccgcaagggccccaagggcgacgagatctggcgcctggacgccgacggcaatgtggtgatccgctcgcccaacgacaccgccaccggtcacaaggcgatctatgacctggacaagtccatcttcgtcctgaagggcgccccggccaagatggtgacccccaccgacaccttcaccgccaccgaaagcctggaatactgggagctgaagaagatggcggtgctgcgcggcgacgccgtcgctgtccaggaaggcggcaagaccctcaagggcgacgtgctcaccgcccatttcaaggacaaggaaaaggacaagcccgccccggcccgccccggcgccaagccggcccaggcggggcagccgtcgggcggcgacggcggcggtctggaactgcagcgcgccgacgcctacggccatgtggtgatcctgtcggccagcgaaaccgtgaccggcgatcgcggcgactataatgccgaaaccggtatcgccaccgtctccggttcggttaagatcagccgcgaaggcggaaatcagctggaagggggatgggcgcacgtgaacctcaacaccggggtcagcaagctgttccccaccgcggccggcgccgccgaaagcggccagagggttcaaggcgtgttcattccacaaaagaaagacaagggcgataagggcgaaacgcccggccgcgccggctttaccggcaacgtgcccacacccgggacggggggacgatgaaaatcatcaagccaggaacgccgctcgccgccgagaagcccgtcgttgcggggccgcgtctggtggccgacaatcccggcctggtggcccgcaacatcggcaagagcttcaagggccgccccgtgctgcgcgacgtctccatctcggtgcagcggggcgaggccgtgggcctgctgggtcccaacggcgccggcaagaccacctgtttctactgcatcaccggcctgatcaaccccgacatgggcgccatcctgctggacggcaccgagatcaccgacctgcccatgtaccgccgcgcccgcttagggatcggttacctgccgcaggaagcgtcgatcttccggggcctgtcggtggaaggcaacatcatggccgtgctcgaagtggtcgagcccgacctggagcggcgccagcacgacctggaaagcctgctggccgagttttccatcagccatctgcgccgggcgcccgccatggcgctgtcgggcggcgagcgccgccgcgtcgagatcgcccgcgccctggcctgccggccccacttcatcctgctggacgagccgctggccggcatcgaccccatcgccgtgtccgatatccgcgacctggtggcccatctcaagcaccgcggcatcggcgtgctgatcaccgaccacaatgtgcgcgagaccctggacctcatcgaccgcgcctatatcctgcacgatggctcggtcctgatggagggccgccccgccgagatcgtcgcccatgaaggggtgcgacgggtctatctcggcgagcggttcagcatgtaacgccccgccatggccatcggtcccaggcttgatattcgccagacccagtctctggtgatgaccccgcaattgcagcaggccatcaagctgctgcaattgtccaatttcgagctgaccgccttcatcgaccaggagctggagcgcaatccgctgctggagcgcgaggaaggcgagcgcggccccgagcccaccgagcccaaggtggattccaccgatctggcggtgctcgactccgctccggccgaagcccccctgctggacggcatgaacggcggctcggccgaagacggcatggacgtggattacgacaacaccttcaacaacgacagcgcctccgacgccgtccaggacgagtccctgggccaatggggcaatgtgggcggcggcggcggcggcttcgacgacggcgagtccaacctggaacagatggtggcgggcgagatcagcttacgcgatcacttggcggcccaggtcagcatggacattcccgacgcgggcgaccggctgatcgccctgcacctgatcgaaatgctggacgaggccggctacctgatcggcgacctggacgaactggcggaaaggctgggctgtcccaccgagcgcgtcctggtggtgctgaaaagagtccagggcttcgatccggtcggcgtcttcgcccggtcgctcaaggaatgcctgggactgcagctggccgagaagaaccgcctcgaccccgccatgcaggccctgctggacaatctggaactgctggcccggcgcgacctgcccggcctgatgaaggcctgcggcgtcgatgccgaggacatggccgagatgatcggcgagatcaaggcgctggaccctaagccggccttggccttcgaccatatcgtcgcccagccggtcacccccgacgtgctgatgcgccgcacccaggacggcgcctgggtggtggaactgaactccgacaccctgccccgcgtgctggtcaatacccgctattactccaagatcgccggcgcggcgcgcagcaaggacgacaagacctatatctccgagcgcttccagtcggccaactggctggtgaagtcgctgcaccagcgcgccaccaccatcctcaaggtggccaccgagatcgtccgccagcaggacgccttcttccgcctgggggtccagcatctgcgcccgctggtgctgcgcgacatcgccaccgccatctccatgcacgaaagcacggtcagccgcgtcacctccaacaagtacatggccacgccccgcggcatctatgaactgaagtacttcttcacccaggccatcggctcggccgacggcggcgacgcccattccgccgaatcggtgcgccaccgcatcaaggcgctgatcgacgcagagggcaagagcgtgctgtccgacgattccatcgtcgacgcgctgaaagccgaaggcatcgacatcgcccgccgcacggtggcaaaataccgcgaagccatgaacatcggctcgtcggtccagcgccggcgggagaagtcgctgggcatgtgacccccggacgtccggcatgcttgacttcggacaagtcggggcctattttccgcccgccccgtaggaaagacgggacggggactatcgcgcggtagagtgtatcccgcgcgttttgatggaagacccagcggaacccgaaggttccgccctcatagggtggattcatggaaatcaccgatctgatcagcccggccgccgtcattccgaatctgcgcgctgcttcgaaaaagcaggcgctgcaggatctggccaagaaggctgccgagattaccggcctgcacgagcgggccatcttcgacgtgctgctggagcgcgagcgcctgggcaccaccggcgtgggcaacggcatcgccatcccccacggcaagcttccggccatggaaaagctttacggcgtgttcgcccgtctggaaaagcccatcgccttcgagtccatcgacgagcagccggtggacctgatcttcctgctgctggcccccgaatccgccggcgccgaccacctcaaggccctggcccgggtatcgcggctgctgcgcgacaagagcgtgtgcgagaagctgcgcggcaccgacaatgccgacgccctttacgccctgctgaccgaaagccccgccagccgggcggcgtaagaatcttcgcgaaaagttgctgacgctgccccgccgcgcgcggtccttcgccctgcgggctcagtgtactttccgcgaggaactattgaaaaaatgggcttaaggcggcttcgcgcccatttttgacttaaccttacccagtccgagaccctgtctcggactggggagaaataaagccaaagcccgtgcgccgggccgccccaagcgcgggcctttccttaatcaccaccgcacgaaagtacactgaggccgcaaggccgaaggactttcgtgcgaattcatcaatgcacgctcatgggctccatgtcgtgctgcaggatggcggcaaaggcggtgtcgcgcgacggggccgcgccgatcaccgtgccgtcggcggcgtggatggaccagccgccctggccgccattgtcctcgtgcttgaaataggcgatggccggcatgccccagttggcgaaatcggtggcgttcatcaggccgtggctgagaagcacggttctgtcatccatggtcttcatgttcagacctcccttttctggccggttctggcccgggatgacgccgacggggtttcatcggcggaaacggtgatggtgtggggaacctcgcccccgcgcccgatgggaatggtgcgaaccttgggctccggcacccggcggatcagatcgacgtggagcaggccgttgtccagcgacgcccccgtcacctccatgccgtcggccagcaggaaggcccgctggaactgcctggacgcgatgccgcgatggatgaacatccgggtggcctcgtcctcggactggcggccacggatgaccagctggttgtcttcaagggccaccgacaggtcgtcccacgagaacccggccacggcgagcgtgatgcgcaggccgttctcggacatctgctcgatattgtaggggggatagccctcgggcgaggccttggacatgcggtccaacagccggtcgaaatgatcgaagccgagcagcagcggggaattgaacgcggacaaacgggacatgatcttcgtcctcctcgggcatgagcgagtacgccaaggaagggcccgacatcggcacccttcgatatattatcttgggggaaattaagggatcgtcaagcgaccctggatttgtcatcccgacgaccagaggggaggaaggatctcatcctggcgcgatccgtcagaatcggcccccagtatccgggcggagattcctcgctttgctcggaatgacagacgggcctcaccagcccttccgaaggccgcccaccaggtccacgtaatcgtgctcgacatcgggcgagatcaggccgtgccggatcagaaagtcgaggatcaccaggttgacgttgaacttgaactcgtcggtatccctgaccagccgcgccacctcggccaccggcatcagggtgaagccctgaagctcgccgtcggtgttgcgcggcgtgaaggtctcgggcacctccaggtcatagcagaacatcacgtccggcttgagcccccaatcgtcctccagacagtaggacaccacccccgccggccgggcggtggccgccagttcacgcggaatgtcggcctcctcggccgcttccttgatcaggttctcggccagggacaggtcgctgggctgaccgcccgccaccatgttgtccagcttaccgggcgccacgctcttgtccttggcgcggcgcccgatccacaggtgaaggccgtcagggcggcgtaccagaccgttgacgtggacgccataggcgcggatgccgaacaggctgaccacgccgcggtcgatgctcatcagggccggatcgccgaagcgggccgccacccgatagcgctcgccccgcgccttgggcgtgccccaatcctcggccagttcccgcgtcacctcgtcgatggcggcgctgcgcgcctcgggggtggacagggcgggatggaggctgaccccttcgaccgagacgcggaacgcctcgggaaacgccgccagacgctgggccacgtcgtggcgcacccagccgatccatttcccctccaccgagaacggccggaacttggacaggtcatggcggttgcaggttcggatatggtccaggaaggccatgggtcgggctccggcgggaagggcggccaagggtgacgcccgtcggagctgccgtcaaggctgccacacggcaaaattcgtttaagaaatattcatacgatgctgccaccccctgttctcgccacgggaaaagctgtaaaagaggggcatgaggaccctttaccaccacccgctctgcccgttctcgcgcctggtgcgcatcgtgctcgccgagaagaagctggacttcgagccccagatcgaaaagacctgggaacgccgccccgaattcctcgccctcaatccggcgggcgtgctgcccgtgctggtcgaagaggacggcgccgccctggccgacgccaccgctatcgtcgagtacctggaagagaccagccgcgagacgccgctgctgcccgccgagcccctggcccgcgccgaggtccgccgtctggtcgcctggttcggccagaagttccatgccgaggtcaccgaccatctggtgggcgagaaggtcttcaagcgcctggaatcaggacgcaacgaacccgattcgcgccgcatccgcgccggcttcggcaatattcaccggcatctcgattatctcggcaccctgaccgagcggcacggctatctggcgggaggcgccttcaccctggccgacatcgccgccgccgcccagatctccgccgtggactacctgggcgacgtgccctgggaccagcatgccccggccaaggactggtacgcccgcgtcaagtcgcgccccagcttccgcgtcctgctggccgaccacctgcccggcctgccgccgccccggcactatgccaatccggatttctagcttgatctttgcccctcgccgggcgcggccctccggccgcttggccgccgcctcaatggcggcattgtttgcccctcgccgggcgcggccctccgaccgcttggccgccgcctcaatggcggcattgtttgcccctcgccgggcgcggccctccgaccacttggccgccgcctcaatggcggctgtcgcatttctcctcctcctcgccgccccggtccgggccgaggtgatcgagcgcctccccaccgccgacaaggtggtggcgctgaccttcgacgcctgcgaggccaagggcgcgcccgcctatctcgacgcctccatcctgaaggttctggaggccgagaaggtgcccgtcaccatcttcgccagcggcctgttcgcccggcgcaacgccgcagaactgaaagccctggccgccagccccctggtacgggtcgagaaccactccctcgaccacccccagcacatggaacgcctggacgccgatgccgtccgccgtcaagtcgccgaggccgacgaggccattcaggccgccaccggacgcaagccccgcttcttccgctttcccgccggcaattacgacgccgccaccctggccacggtcgaggccaccggccacaaggtggtgcactggaccttcgcctcgggcgacccggccaggggcgtgacgcccgggcacctgaaggactgggtgctgtccaagacccggcccggctccatcctgatcttccacgtcaaccagcgagcccccgccaccggccccgccctgcccgccattctggccgagctgcgccgccggggctatcgcttcgcgtccctggacgaggtcctgccgtgaccgccatcgccctggacggctgtcggctgcgcccgctggaaagcgaggacgcccgccccctggcccagaccctggccgccatggacccctgggcccgcctcggctatggcgaagcggcgctggagcgctatctcggccgcgacgacggggcgctaagccgctgggtggtcgaacacggcgacgcgcccgccggcctgctggcgctgcgctcgccctggctgcgcggcccctatgtcgagctgttcgccatcctgcccgcgttccagggccacggcctgggcggcacggtgatggactgggcggccaaaagcgccgccgaactcgcccccaacctctgggcctgcgtctccgacttcaacgcccccgcccgcgccttctatgcccgccacggctttgtcgaggtgacggggctggacgggctggttcaggcgggcatgagcgagattctgctgcggcgccgcctacagcaataggctgcccagggccgccacgccgaacaccatcagcatggcgccggacaggtggttgaagagccgcatgcgttcgggggtgaagcggttgcgcgccgccgaggccaggcccgacagggtcagccaccacagggccgagccgccgaagattcccgccaccagcaggccggtgggcaggccgacgcccggccgccccatggggccgagggcggcgaagacccccgccaccccgaagatggtgccgggattggtaatggtgatggcgaaggtggacaggaagtcgcggagcatgccgggaccctggcccggctcggcctccaccgacacggcggccgagcgccaggtgtgaagccccaatcccagcatgaacaggcctcccaccactttgagcaccaccatctggccgtcgatgaagctcatcaccgcgccgatgccgaaggccgccgccgcgccgaacagggtatcggcgcaggccgcccccagcccggcgacaaaagccgccagccgtccgtcggccagggccttcctgatgcacaggatgcccaccggcccgatgggtgcggcgatggcgaagccgatggcgattccacgcaggaacgagatgacggggtccacaaggcacctttaggggcgaaacggagtgccagaaaagaccaaaacccgcccccaggcaacaggcaggagccccgactcgggattgttcttaggtgcgcaacaaaggtcgacacagcctatggatgcgcacgccgattttacattccaaatggagatgttcgctgatattttttctcgcattggaaataagggggcatttgtcgtgctcgaaatcagaatcggggaggatgaaccatgttcctgggtcccgtcatcaacgtggcgatcggcctgatcgccatcttcgcgctgatggccctggtggtgagcggcaccacctcggccatcacggcgttcttcaacaccgccggcaaatccctgtcggacgcggtgaggaacctgctgaacgatcccgccggcaaggggttggccgggctggtcatgaaccatccccagatcacccccctggtgctcccggtggagccgggcgcggccatcggcagttccaagcttcccgccaccatcgagccccgcaaattcgccctggcgctgatccagtcggcccagttgaagcaggggctgacgccgctggagctggacaagaccatcgccacggtgaccgatccccagatcaaggaattgctgacctcgctctacgcccaggccaacggcgatctggtcaagctggagaccgagctttccgggtggttcgagaacgccatgacccatctgagcgaggcctatggccgcaggatcaggctgatcagcctgggcatcgccgcgcttctggccgccctgctcaacgtcgacgccctgcatgtcgcccggggcatctgggccagccccgacctggtcgggcaactggccggggtgcagggcgtcgatgccgatgccttcaaggcgatgaagcagttggcggccggcggctttcccgtgggctggacccccgagcgcatcgccgccgtcagggcggacgggggaggcctgctcctcctcaccatggttcccggctggctgtgcaccgccgccgcctccatgctgggagcgccgttctggttcgacctgctgaagaagctgcgttcggcaaccgcgtccgtggccgcggcggctccgcccgctccggctgtcaccacggcgacggcgacagccacgtcgattccggcgaagacctaaaccggcagaggcggaaagagcgtagtgggcagggcgatctcgtcctgccccgccaccagggccatctcccgcccgccccggctccgcgtcgcctccagaatgccgaacaggctggacaccgccagggacagcgcctcaggcaaggcccgtcccttgaggacatggccgagcagcagcgccgacaaggtgtcgccgccgccattgggcggcgtggcaaagggcagcaggggcgtgcgcaccagccatgcgccctggccgtccaccgccagacagccgatcaggccatcccccgccggcaggctggtggtcaccaccgccttgactccgcccgccatcagcacgtgcgacgccgccaaggcatccgccacgtcgttgatcgaccgaccggtcagcaatcccagctcgaaccggttgggggtggccagatcggccaggggcaacagggtccgggcgaaaatctcgggaatgccggcatcgacgtaaagccgcccctcgtcgcccatcaccgggtcgcagagatacagggcgtccggacgcaggcgccgcagacggcgcaccgccccggccaccacgtcgccggttccggcctggccgagatagcccgacagcaccgcgccgaaagcgtccagcaatccggccccctccagcccgtcgaccatctcgcccagggcttcggccggaagcgcgcggccacgccaggctccgtggccgggatggttggagaactgcaccgtatccaccggacaggcgtccagccccaggcgctgcagggcgaacagggcggcggaattgcccacatggccgaaggtcaccgccgactggaaagaaagaatcttcatgtcgcggccggtatagacgatgcaatgttgcgccgcaaccgggccttcgggtagtctgccccgccttttgtcattttcgggagtttcgtccatggcgaccaccgcgcggccccgccgttccgtcctctacatgcccggctccaatccgcgcaccctggaaaaagcccgcacgctccccgccgacgggctgatcctcgacctggaagacgccgtcgcccccgacgccaaggacgtggcccgctcccaggtggtggacgcggtcaaggccggcggctacggcgcccgcgaactgctgatccgcgtcaactcgctcgccaccccctggggccaggccgacgtggccgccgccgcctcgtccggcacccacgccgtgctgatccccaaggtggaaagcgccgacacggtgcgtcaggtcgaagccatcatggtcgccaacggcgcgcccgccgacatggccatctggtgcatgatggaaacaccgcgcggcatgctgaaggccgaggagatcgccggctccagcccccgcatgggcggcttcgtcatgggcacctcggatctggccaaggacctgcattgcgcccatacccgcgaccgcctgcccatgatcaccagcctggggctgtgcctgctggcggccagggcctatgggctggccgccctggacggcgtctatctcgacctcaacgacgacgagggcttcgcctattcctgccagcagggactggaattgggcttcgacggcaagaccctgatccatcccaagaccatcgagaccgccaaccgggtcttcgccccggcggagaaggagatcgagtggtcgaagaagatcatcgccgcccatgccgaagccagtgccgccggcaagggcgtggtggtggtcgacggcaagctgatcgagaacctgcacgtggaaaacgcccggcgcatcgtggcgctgtccgaccagatcgcggccatggctcaggcataatcctcaaccggagagcacctcgagcccgtgaagcgggcgctggcgcattgagcgccccggagcgcaagcggaggagccaagggtgcgcaggcgcccgcccggcgcttgagggacaatgaaaggaccatcatcatgaccaagaccaattccggtaacttcttcgaggacttccgcctcggccaggtgatcaaccacgccacgccgcgcaccgtcacctcgggcgacgtggcgctgtacaccgccctttacggctcgcgcttcgccgtcaattcctcggccgagttcgccaagtccatcggcctgggcgccgaaagcatgggccacctcgcccccgtcgacgacatgctggccttccacgtggtgttcggcaagaccgtgcccgacatcagcctcaacgccgtggccaatctgggctatgccgcggggcgcttcggcgagatggtctatcccggcgacaccatcaccaccacgtcgaccgtgatcggcctgaaggagaactccaacaagcagaccggcgtggtctatgtccgctcggtgggcaccaaccagctgcgggaaatggtggtggagtatgtccgctgggtgatggtcaagaagcgcgacgtcagcgccccggcgcccgaggaaaccgttcccgacctgcccggcgccgtcgccgccgccgatctggtgattccggaaagcctcaccctcggcgcctacgacaccaccctggccggcagcccccatctgtgggacgactacgcggcgggcgagaagatcgaccatgtggacggcatgaccatcgaggaagccgagcacatgatggccacccgcctgtggcagaacaccgccaaggtgcacttcaaccagtacaccgagggccagggccgcttcggccgccgcctgatctatggcggccacatcatcagcctggcccgcgccctgtccttcaacgggttgggcaacgccttcaagatcgtcgccatcaacggcgggcggcacaccaacccgaccttcgccggcgacaccatccacgcctggaccgaggtgctggaaaagatcgaggtgcccggccgcaaggacgtgggcgcgctgcgcctgcgtctggtcgccaccaagaaccagccttgcgccgcccatcccctcaaggcggaaaacggcaaggacttcgacccggcggtggtgctggacttcgactacaccgtgctgatgccgcgccggaagtaggacggaacggacgcggggggcctcgtcccctcgtgtccccctccgaattcctccgtccgccagaaagcgcttcaccccaggcatttggccgtatcatgccgacctcggtgttcagccctactccgtccgggtaggctgccctgccgaaaagtgtggtttcctatcgttgactctggggcctcgaggggctaaacacctaccgcatcgccgcaaagggccgacacaaggccctcgtcgtccgtatttcaggggctctagccatgacaacgcgcacccggccgctttcgcctcatatccaggtttatcggatgccgttcacggccatcctgtccatcagccaccgcatcaccggcgtggctctcgcggtcggcaccgtcgtgctggcgtattggctggcctcggccgcctacggccccgtcgcctatggccacgcccaggccgtgctcggctcttggctgggcaagctggtgctgttcggctggaccgcggccctgttctatcacctgtgcaacggcatccgtcacctgttctgggacaagggccgtggctacgagatcgccgaggccgacaagtcgggccgcatggtcgtgggcgccgctgccgcgctgaccgtgctggcctggatcttcggcctgtaatcgggagagcgcatatgagcctcgaatcccctgtcggccgcgcccgcggcctcggttccgccaaggaaggcgccggccactggatcgcccagcgcgtcaccgccatcttcctgatccccctgtcgctgtggttcgccgtctccgtgatcggcctgtcgcacgcagactacgccaccttcaaggcgtggatggccaagcccggcaattcctcgctgctgctgctgaccgtgctgaccgtgctgtaccacgcccagctgggcctgcaggtggtgatcgaggactacgtcagctgcgagtgcaagaagatcgcggccctggtcgggtccaagctgatcatcgccttcctcgccgtcttcatgacggtgtcgatcctcaaagtcgcgattggagcctgacgccatggctgcctacaagattatcgaccacacctatgacgtggtggttgtcggtgccggcggcgccggcctgcgcgccaccatgggcatgggtcaggccggcttcaagaccgcctgcatcaccaaggtgttccccacccgctcgcacaccgtggccgcccagggcggcatcggcgccagcctgggcaacatggccgaggataactggaagtggcacatgtacgacaccgtcaaggggtcggactggctgggcgaccaggatgccatcgagtacatgtgccgcgaggccgtgccggcggtgcatgagctggagcatttcggcgtgcccttctcgcgcacgcccgaaggcaagatctaccagcgcccgttcggcggccacatgtccaatttcggcgagaagccggtgcagcgcgcctgcgccgccgccgaccgcaccgggcatgccatcctgcacacgctgtactcccagtgcctgaagcaccagtgcgagttcttcatcgagtacttcgccatcgacctgatcatggagaacggcgcctgtcgcggcgtcgtcgcctggaacctggacgacggcaccctgcaccgcttccgcgcccataaggtcgtgctggcctcgggcggttacggccgcgccttcttctcgtgcacctcggcgcacacctgcaccggcgacggccacggcctggtcgcccgcgccggcctgccgctgcaggacatggagtttgtgcagttccaccccaccggcatctacggctcgggctgcctgatcaccgagggtgcccgcggtgaaggcggctacgtcaccaactccgccggcgagcgcttcatggagcgctatgcccccaccgccaaggacctggcctcgcgtgacgtcgtctcgcgcgccatgaccatggaaatccgcgaaggccgcggcgtgggcaaggaacacgaccacatcttcctgcacctggagcatctgggggccgagaccctggaactgcgcctgccgggcatttccgagacggcgaagatcttcgccggcgtggacgtgaccaaggagccgatcccggtgctgccgaccgtgcactacaacatgggcggtatccccaccaacgtgtacggcgaggtcctgcgccccaccgccgagaaccccgacgccaccgtcgagggcctgatggccatcggcgaggcggcctgcgtctcggtgcacggcgccaaccgcctgggcaccaactcgctgctggacatcgtggtgttcggccgcgcctgcgccctgcgcgccgccgagaccatgaagcccggcaccgcccacaagccgctgcccaaggacggcagcgacctggccctgtcgcgtttcgatcgtctgcgcaatgccaacggctccatgcataccagcgagatccgtctcgccatgcagaagaccatgcagatggacgcggcggtgttccgcacctccaagtcgctggccgagggctgcgccaagatggatcaggtcgcgtcgaccctgccccagctcaagatcaacgaccgctccaccgtgtggaactcggatctggtcgaggcgctggagctggagaatctgatggattgcgccctggccaccatcgtgtcggcggaagcccggcacgaaagccgcggcgcccacgcccacgaggattatcccgaccgcgacgacgtcaactggcagaagcactcgctggcctgggtcgagaacggcaaggtgaagctggactaccgtccggtgcacacctacacgctcaccgacgaggtcgagtacatcaagccgcagaagcgcgtgtactaaggaagggttaggagaacgcacatggttgaattcgccctgccccccaattcgcgggtccagcccggcaaggtctacaaggccgtcggcgccaagaacgtcaaggtcttcaagatctaccgctacgaccccgatgccaacgccaacccgcggctggacagctacgagatcgatctcgacgcttgcggccccatggtcctggacgccctgctgaagatcaagaacgagatcgactcgaccttgaccttccgccgttcgtgccgcgaaggcatctgcgggtcgtgcgccatgaacatcgacggcaccaataccctggcctgcctcaagcccatcgaggacatcaagggtgaggcggccatctatccgctgccgcacatgccggtggtcaaggacctgatccccgacctgaccctgccctacgcccagctggcctccatcaagccctggatgcagacccagaccgctccgccgcccgacggcgagcgtctgcagagcccggaagagcgcgagaagctcgacgggctgtgggaatgcatcctgtgcttctgctgccagaccagctgccccagctactggtggaacggcgaccgctatctcggcccgtcggtgctgctgcaggccgcccgctggattctcgactcccgcgatgagatgaccggcgagcgtctggacgaccttgaagaccccttcaagctgtatcgctgccacaccatcatgaactgcaccaagacttgtcccaagggcctcaacccggccaaggccatcggtgcgatcaaggaaaagatcatggagcgccgcgtctgacgcggcctttcatggcatgaacggaaaaggggcggttcccgcgggaaccgcccctttttcatgacttgccctctgctgaattctattcctcgccctgcgggctgcgtatccgccgctcggtttgccacgccttgacctgggcattggagaaggggttcaccaagtggccgtcggccatgcgcatctcggggtcgaagcaatagtaggaggccagatggggggccgtcatacggcactgccaccgcctctcggtgaccagaaccgccttcaggccgtagacctcgcaggcctcggccgccaggcggtcgcgctccgcccggggcgtgtcgccctcataacagacggtgacctgcccatcgtagccgggcagcttctgcttcttgaccgagcggtccatctcatgccggtcgacgaaggcattccccgaggagcaccccccaagcacggccagggcgacaatgagagcggcactgcgaaaggcaagcatctgcgagacccgtaaaaaccggtggggcggccccaatgtttaaaccaaagtccaggttttggaaacattcctgcgcctgggacgttgcccctggacccgctcggggctattctcggggaaatggcatctccccctggggcgggaaagaggagtaggtctatgtccgacggcaagaaattccggctggttacccgcagcgacttcgacggtctggtctgcgcggtcctgctgaagcagctcgatctcatcgacgacattaagtttgtccaccccaaggacatgcaggatggcatcatcgagatcgggccgaaggacatcaccaccaacctgccctatgtggagggtgtccatatcgccttcgaccatcacctgtccgagaccatccgggtgggcaagaaggaaaaccacatcatcgaggccgaggccccctcggcggcccgtgtggtctataactattacggcggcgccaaggtgttccccgcctcgtgggacgagatgatggcggcggtggaccagggcgattccgcccagtactcgcttgaggagatcctcgaccccaccggctggaccctgctgaactacatcatggacgcccgcaccggcctgggccgtttccgcgagttccgggtgtccaactaccagctgatgatggacctgatcgattactgccggaaccacaacatcgacgagatcctggccctgcccgacgtcaaggaacggaccgacatctatttcgagcacgccgacaagttcaaggaacagatcaagcgctgctccaccgttcacaagaacctggtggtgctggacctgcgcggcgaggagaccatctacgccggcaaccgcttcatgatctacgcgctctatccggagaccaacatctccatccacgagctgtggggcgtgaagaagcagaacaccgtcttcgccatcggcaagtccatcgtcaaccgctcgtccaagaccaatgtgggcgagctgtgcctgaaatacggcggcggcggccacatgaacgccggcacctgccaggtggacaattcggtctgcgacaaagcgctctccgacatcatcgccaagatcaacgccgacggctgagcctgcggccatccatgaccgggcgggaggaaactcccgcccgcttcatttcaggagcttaggggaaccatgggcgaaggccccctgtttgcctaccgcgccaaggtcgccagcggcgaggtgcgacccgacgtcgcccaggaactggccatggagaagctgcaaagccttcaccacgccctggcgcgctatcgccccgccctgggcgagaccggctggctggcccgcttcggcctgaagaaggcggcacccggctcctcctggacctggggcgccggcgacctcgccacccaggcggcgcccaagcatggcctgtacatcttcggcgaggtgggacgcggcaagtccatgctgatggacctgttcttccacaccgcctccatccccggcaagaagcgcgtgcacttccacgaattcatgcgcgacatccaccgcgacatccacaaatggcgccagacgccgtcgcgcggtgatgccgaccccatccccaagctggcccgctccatcgcgtcggaggcctggctgctctgtctcgacgaactccaggtcaccgacatcgccgacgccatgatcgtcgggcgactgttcaaatgcctgatggacgacggcgtggtggtggtgatcacctcgaaccgccatcccagggacctgtacaaggacgggctgcagcgcgaccgcttcgtccccttcatcaagctgatcgaagacaagctcgacatcctggagctgaactccgagcgcgactaccgcctgggccgcaagcgcggcctgcaggtctaccacgcgccgctgagcgaggaggcggagaacgccctggaactggccttcgcccgcctgaccgagggcaccagcaccaatccccacaccattgaggtcaatggccgccagttgcgcgtgcccctggccggcgccggcgtggcccgcttctcattttctcagctctgcggcacggcgctgggtcccagcgactatctcgccctggccgggcgctatcacaccctggtgctgtcggacatccccctgctgtcgcccgccaacaaggacgaggcgcggcgcttcgtcaccctggtggacgcgctgtacgagcacaaggtgaccctgatctgctcggcggccgccccgccggaaacgctctaccccgaaggcgtcggcgccttcgagttccagcgcaccgtctcgcgcctgatggaaatgcaggccgaggattacgtgatgcgggagcatctggggtaggacggcggttgcgccgcaccacggccaagcccacccccaagggtagccaacaaccccctccgggtaggctttcctataacgagtccaaagcattacggcattggtcgtaccgctttgaggccagtgtacggaaatcccacggtttcccggcggagccgctttgcatgggctgcatgccaatccgcttgcccttgggcgcgaatcgcgttacctaagccccccaggccagttttgcgcgcagcggcgcgccccacccgttcgtctagaaccatctcacgatttcgagggaactccatccatggcacgcaagaagatcgctctcgtagggtccggcaacatcggcggcacgctcgcccacctgatcggcctcaaggaactgggtgatgtcgtcatgttcgacatcgccgagggcatcccccagggcaagggtctcgacatcctcgagtccaccccggtcgagggcgtggactgccgctattccggtgccaacgactactccgccatcgctggcgccgacgtggtcatcgtcaccgccggcgtgccgcgcaagcccggcatgagccgcgacgatctggtcggcatcaacctcaaggtcatggccgccgtcggcgaaggcatcaagaagaactgccccggcgccttcgtgatctgcatcaccaatccgctggacgtgatggtctgggcgctgcagcactattcgggcgtgcccgccaacatgatcgtcggcatggccggcgtgctggattcggcccgcttccgcaccttcctgtgcgaagagttcaacgtctcggtcgaggacgtcaccgccttcgtgctgggcggccacggcgacaccatggtcccgctggtccgttactccaccgtcgccggcattccgctgcccgacctggtgaagatgggctggaccacccaggagaagctcgaccagatcgtgcagcgcacccgtgacggcggcgccgagatcgtcaacctgctgaagaccggctcggcctactacgcccccgccgcctccggcgtggccatggccgaagccttcctgaaggacaagaagcgcgtcctgcccgtcgccaccctggtcaagggcggcacctacggccagcccgacgacgtgttcgtcggcgtgccggtggtgatcggcgaaggcggcgtggagcgcatcgtcgagatcgagctgaacgccgccgagcaggccgagttcaacaagtcggccgacgccgttcgcggcctggtcaaggtcgccaagggcctgatgggctaatcgacaagacactcaaggggagcaagacccgatgaatattcatgagtatcagggcaagcaggtgctggccaagtacggcgtcgccgtgctcaagggcggcgtcgcctacacccccgacgaggcggtgcaggttgccaaggacctgggcggcccggtgtgggtcgtgaagtcgcagatccacgctggtggccgcggcgccggccgcttcaagaacgaccccaatggcaagggcggcgtccgcgtcgccaagtccgtggaagaggtcaagaccaacgtcgaccagatgctgggtcaggttctgatcaccaagcagaccggcccggccggtaaggaagtcaagcgcgtctacatcgagcagggctgcgacatcaagcgcgagctgtacctgtccatgctggtcgaccgcgccacctgccgcgtcaccatcgtcgcctccaccgagggcggcatggagatcgaggaagtggcccacaaccacccggaaaagatcctgaaggtcgccatcgatccggtcgagggcttccagcagtatcacggccgccagatcgccttcggtctcggcctcgagggcaagcaggtcaacacctgcgtcaagttcgtcggcgcgctgtacaaggccttcatggacctggattgctccatcgtcgagatcaacccgctggtggtcaccggcgccggcgagctgatcgctctcgacgccaaggtgaacttcgacgacaacgcgctgttccgtcacaaggacatcgaagagctgcgtgacgagtccgaggaagacccggccgagctcgaagccgcccgccacagcctgaactacatcaagctggacggccagatcggctgcatggtcaacggtgccggcctcgccatggccaccatggacatcatcaagctgtacggcgccgagccggccaacttcctcgatgtcggcggcggcgccaccaaggagcgcgtgaccaccgccttcaagctgatcctctcggatcccaacgtcgaaggcatcctggtcaacatcttcggcggcatcatgcgttgcgacgtcatcgccgagggcgttgtcgccgctgcccgcgaagtttcgctgaacgtcccgctggtcgttcgtctggaaggcaccaacgtcgagttgggcaagaagatcatggctcagtcgggcctgccgatcattgccgccgacaatcttgccgatgccgccgagaaggtggtgaaggccgtgaaggaggctgcataaaaatggccgttctcgttaattccaacacgaaggtgatctgccagggcttcactggcgcccagggcaccttccactccgagcaggccatcgcctatggcaccaagatggtcggtggcgtcacccccggtaagggcggcaccacccatctcgacctgccggtgttcaacaccgtcgccgaggccaaggccaagaccggctgcaacgcgtccgtgatctacgtgccgccgcccttcgccgccgacgccatcctggaagccatcgacgccgagatcgagctggccgtctgcatcaccgagggtatcccggtggccgacatgctggccgtcaagcgcgccctgcagggctccaagacccgcctgatcgggccgaactgccccggcgtcatcactcccggcgagtgcaagatcggcatcatgcccggccacatccacatgcgtggcaagatcggcatcgtgtcgcgctccggcaccctgacctacgaggcggtcgctcagaccaccgccaccggcctgggccagaccacctgcatcggcatcggcggtgaccccatcaacggcaccaacttcgtcgacagcctggagctcttcctggccgaccccgagacccaggcgatcatcatgatcggcgaaatcggcggcgacgccgaggtccagggcgccgagctgctgaagcgctccaagatcaagaagccgaccgtcggtttcatcgctggccgcaccgctcctcccggccgccgcatgggccatgccggcgcggtgatctcgggcggcaacgataccgccgacttcaaggtggaagccctgaagtccgccggcatcgccgttgctgactcgcccgcttcgctgggctcgaccatggtgaagctcctcaagggctgatccaactagtaccgaatggtccggcgcatcgccggagcgccggaccgccggtgcgtcggaccgttttaaataataataaaaatatagtttgcgccgtagacagagcggcacccggcggcgccgcccggcccaagcacgaaagggacgcgggctagaacctgcgtcgaatcccgaacatgacaaagcagttcgacgaatcgtcctttctgagcggtggcaacgccgtcttcatcgccgagctttatacccgctatctggaggatccggcttcggtcgattcctcgtgggtgtccttcttccaggacctgaaggacgacggctcgcagttggtgcaggacttcaagggcaccgccagcgccagacgcgacctcaagatcatcggcgccgtcgaccccgaggccgccgccgccgccgcggccgccgccaagaagggcggcaaggatgccggaaagggcgccgccgccccggccgccgatcccgccgccatccgccagggccagatcgactcgatccgcgccctgatgctgatccgctcgtatcgcgtgcgcggtcacctgatggcgcagctggacccgctgggcctgtccaagcccgagcagcatcccgagctggattaccgcacctacggcttcaccgatgccgatctcgaccgcgagatcttcatcgaccatgtgctggggctggaaagcgcctcgctgcggaccatcgtgcgcatcgtgcaggagacctattgcgccaggatcggcgtggagttcatgcacatccaggaccccgatcagaaggcctggattcagaagcgcatcgagtccatccacaaccgcaccgactttaccgcgcgcggcaagaccgccatcctggagcgcctgaccgaggccgagggcttcgagcgcttcctgcagatgaagtacaccggcaccaagcgcttcggccttgagggcggcgaaagcgtcattccggcgctggagcagatcctcaagcgcggctcgcagctgggcgtcgacgaggtggtgatgggcatggcccaccgcggccgtctcaacgtcctggccaatttcatgaagaagccctaccaggccatcttctccgagttccagggcaacgccgccaacccggaagacgttcagggctcgggcgacgtgaagtaccacctgggcacctcggccgaccgggatttcgacggcaagaccgtccacctgtcgctgatgcccaacccctcgcacctggaagtggtcggccccctggtggtcggcaaggtgcgcgccaagcagacccagttcggcgacaccgagcgcaagcgggtgatgggcatcatcctgcacggcgacgccgccttcgcgggtcagggcgtggtgccggagaccatgctgctgtcgcagctcaagggctatgccaccggcggcaccatgcacatcatcatcaacaaccagatcggcttcaccacggcgccgcagtattcgcgctccggtccccattcgtcggacgtggccaagggcttccaggctccggtgttccacgtcaacggcgatgaccccgaagccgtggtgcacgtggcccgcatcgccaccgaataccgccaggaattcggcgccgacgtggtgatcgacatggtctgctatcgccgtcacggccacaacgagtcggacgaaccggccttcacccagccgcagatgtaccgcaagatcgcctcccaccccaccacgcgggccatttacatggagaagctggtggccgaggggacgctgtcgcgctatgacgccgacgccatcttcgccaacttccaggcccgcctcgagcaggactacgaagcggccaagagcttcaaggtcaacaaggccgactggctggaaggcaagtggcagggcctggcccagctggccgaggaagaagagttccgcgaggagaagaccggcgtggccgccgatatcctcaaggaagtcgggcacgcgctggcacgcacccccgagggcttcaacgtcaacaagaagatcgtccgccagctccaggccaagaaggagatgatggacaagggcgagggcatcgactgggccaccgccgaggccctggccttcggcaccctgctgatcgagggcaacggtgtccgcctgtcgggccaggattgcggacgcggcaccttctcgcagcgtcactgccgcctgaccgaccaggagaccgaggaccgcgtcgagcccctcaaccacatccgccccggcaaccaggcctatttcgaggtcatggactcgccgctgtcggaagaggcggtgctgggcttcgaatacggctattcccaggccgagcccaacacgctgaccctgtgggaaggccagttcggcgatttcgccaacggcgcccaggtgatcatcgaccagttcatcaactcgggcgagtccaagtggctgcgcatgtcgggtctggtgatgctgctgccccacggctatgagggccaggggccggagcactcctccgcccgctgggagcgctatctccagctctcgggcgaggacaactggcaggtctgcaacatcaccacgccggccaactacttccacgcgctgcggcgtcagctgcgccgcaacttccgcaagccgctgatcatcatgacgccgaagagccttctgcgtcacaagctgtgcgtctccaagctggacgatctggtcaccggctcgcgcttccgccgcgtgctgcccgagaccgagaccctggtggccgatgccaagatccgccgcgtgctgctgtgctcgggcaaggtctattacgacctgctggaagagcgcaccaagcgcggcctcaaggacgtggccatcatccgcgtcgagcagctttatccctggcccaaggacaccatcaaggcccagctggcccgctatcccaacgccgagttgctgtgggtgcaggaagagccggccaatatgggtccgtggaccttcgtcgaccgccgtatcgagttcatctgcgaggaactggatatcaaggcgaagaaggccctgtattgcggtcgccgcgccgccgcgtcgcccgccaccggcctgtacaagacccacgtggccgaacaggaatggattaccggcatggcgctgaccggcgagctggtcaccctgccccagccgttccgccgcgcttccaagctctcccgtctgaccgcctagaaaggggaaaccacaaaaatgaccaccgaaatcaaggtgcccaccctgggcgagtccgtgaccgaagccaccatcgccaagtggttcaagaatgtgggcgatgccgtccgcgccgatgagcccctggtcgaactggaaaccgacaaggtcaccgtcgaggtcaacgcgcccgccgccggcacgctgaccgacatcgtcgccgccgccggcgccaccgtggaagtgggtgccctgctgggcgtcctgggcgccgccggtgccgccgccgccccggcccccaaggccgccgctccggctccggccgccgccccggccgccgcgggcgtcatgccctcggccaaaaagatcgccgccgatgccggcatcgacaccgccgccatcagcggcaccggcaaggacgggcgggtgaccaagggtgacgtgctggccgccgccgccgctccggctccggccgccccggcccccaagcccgccgccccctcgggcccgcgtgccaaggccgaccaggaagagcgggtcaagatgacccgcctgcgcaagaccatcgccggccgcctgaaggaggcccagaacaccgccgccatgctgaccaccttcaacgaggtggacatgacggcgctgttcgacgtcaggaaccagtacaaggaccagttcgagaagcgccacggcaccaagctgggcttcatgtccttcttcgtgaaggcctgcgtcgccgcgctcaaggattggccggcggtcaatgccgagatcgacggcgacgatctggtctacaagaagtactacgacatcggcgtggccgtgggcaccccccagggcctggtggtaccggtgctgcgcggggccgaccagctgtccttcgccggcgtcgagcagggcatcgccaacctgggcaagaaggcccgcgatggcaagctgtccatggaagacctgatgggcggcaccttcaccatctccaacggcggcgtctatggctcgctgatgagcacccccatcctcaataccccccagtcgggtatcctggggatgcacaaggtgcagcagcgccccatggtcatgcccgacggctccatcaaggcgcgccccatgatgtatctggcgctctcctacgaccaccgcatcatcgacggccgcgaggcggtgtcgttcctggtgcgcgtcaaggagtgcatcgaggacccgcagcgcatcctgctggagatgtaattcctccgtctcccccctcccccgctccggcgggggagggccggggtgggggctgcccccgccttgagaccaagccccctccccaaccctcccccgcctgcggcaagggagggagtctgatcgaggacgcaatccatgtccgatacttccttcgacgtcgtcatcatcggcggtggccccggcggctatgtcgccgccatccgcgccgcccagctgggcctgaagaccgcctgcatcgaaaagcgcggcagcctgggcggcacctgcctcaacgtcggctgcatcccgtccaaggcgctgctgaccgcgtcccaccactaccacgccgccgcgcacgagctgggctcgttcggcatcaaggtggccaaggtcgagatggacgtggccggcatgatgggccacaaggacaaggtggtgtccgataacaccaagggcatcgagttcctgttcaagaagaacaaggtgacctacatcgtcggcgccggcgccatcaccgcgcccggccagatcgaagtcaccgccaaggacggcgccaagtccaatgtcgccgccaagcacatcgtcatcgccaccggctccgacgtcacgccgctgcccggcgtcgagatcgacgaggaggtgatcatctcctccaccggcgccctcgccctgtccaagacccccaagcacatggtggtcatcggcggcggcgtcatcggcctggaactgggcaccgtctggggccgcctgggcgccaaggtcaccgtggtggaattcctcgaccgcatcctgccgttcaacgacggcgaggtctccaagcagatgcagcgccttttggcgaagcagggcatggagttcaagctgggcaccaaggtcaccggcatcgccaagaagggcaagaccgccaccgtcaccgtggagcccgccgccggtggtgccgcggagaagatcgaggccgattccgtcctggtggccatcggccgcaagccctacaccgagggcctgggcctggataaggtcggcgtggcgctggacaagcgcggcttcgtccagatcgacggccacttccgcaccaacgtgccgggcatctacgccatcggcgacgtggtcggcggcgccatgctggcccacaaggccgaggaagagggcgtcgccctcgccgagatcctcgccggtcagcacggccatgtgaactacgaggccattccggccgtggtctacacctggccggaagtggccagcgtcggcaagaccgaagagcagctcaaggccgaaggcatcgcctacaaggccggcaagttccccttcaccgccaacggccgggcccgctccatgaacgaggtcgatggcttcgtcaaggtgctggcctgcgccaccaccgacaaggtcctgggcgcccacatcgtcggccccaatgccggcgacctcatcgccgaagtggtcctggccatggaattcggcgcggcgtcggaagacatcgcgcgcacctgccacgcccatccgggcctgggcgaagcggtcaaggaagcctgcctcgccgtggacggccgcccgctgcacacgtagttttttcgttcccgttgcggaaagggcgtccctcggggcgccctttttgttttggacgtggaaggaaggaaaagaatgcgaagggactcgtcccttcgcgcatccccccttctgtttagaccatcgcgcgcgaaatcagaaacaggctgtcaccctgagcgccgcgaagggtctttcacgcgaggacgcccgccgcttcaggctgaaagatccttcgcggcgctcaggatgacaacctgtctcacatttgacactcggcactttagccttgacctggagttggctccaggttgtagcaaggaggggaaggaggcgtcccatgaagatcggagacctggccgcccgcagcggcctcagccatgacaccttgcgctggtatgaaaagatcggcctgttgccccgtccgccccggtcatcttcggggcatcgggactacgacccggccattctggcgtggatcgaattcctggggcgcctgaaggtcaccggcatgcccatcagccagatgctggcctatgcccgcctgcgcgagcagggggaggccaccctgggcgaacggcggcaaatgctcgaggcccaccggcaggtggtgcgacagcgcatcgccgacctgcaatccagcctcgcccacctggatgccaagattcatcactacgccacactggagacccgccatgacccaggtccatgacacccgttaccagcgcggccttgccgccctgtcagccatcgacggcgaggccggcgagaaggtcgtggcccaactggccgatatcgcgccggatttcgcccgctatctgatcgagttccctttcggcgatatctacagccgtcccggccttgacctcagaagccgcgaaatcgccaccatcgcggccctggccgccctgggcaacgcccaaccccagctcaaggtccacatcacggcggcccttaatgtcggcgtcacgcgagacgagatcgtcgaaatcctcatgcagatcgccgtctatgccggctttcccgccgcgctgaacgccctcttcgcggccaaggaagtgttctcgtcccatccgccgtcgggcgcggcgcaatgatcacgccacctcgcgcccccgtccccgctcgcgcaggaattcgacgaaggccgagtcgtaggtcaggatgtggtcacacagccagcgcttgagcaggtcgaccagttcctccgccaccagctccggccccgacagcatcagccggtcgatcagcacgtccagttggaagatcaggtattcgtggtcatagcgatgggcttcgcagtcgggatagccggcgctttccatgctgtgctgttcgcgggtgaaatgctcgcgggtgaacaggcaaagatcggcgaccgccgaggtcaccacgtccgcccccagccgggccgccgagaacacccggttcatcagggcgaacatctcgcggtgatcctcgtcgtcctgctctgcctgaagcagaaggtcatcggaccactcgatcttctcgttcccccatgaaacaatctcgttcgaggccatatgacaggtatcctcgtcacctggcagcgcccgcacggcgtccccaacgcctaactgtacggtatacacccgatgcttgaattgatacgaaccgaaagtcatggatcattgtggtgagtagcgccccctccctgggcgccaaggccgtcttttgcctgtgcgcggcggaggtgctgaccatggtcggcgtcttcgcctttcctgccctgctgcccgccttcgtgaccgaatgggggctatccaataccgaggcggggtggatttccggggtgctgttcgccggctataccctggcggtgccggtgctgaccaccctgaccgaccgcatggatgccaagcgggtctatctctgcggcgcgctggtggccgggatctcctgcctgctctacgccgtggcggcggagggattctggtcggccctggccttgcgcttcctggccggagtgggactggcggggacctatatgcccggactgaaggccctggtcgaccgcacccggggacccaagcaggcccggtggatcagcttctacaccgcctcgttctccctgggcaccagcggctcgttcatgatcatcggcgccgtggcggaactctggggctggaagtccgccttcgccctggccggcgtcgccgccctggccgccttcgccctggtgctggcgcaactggagaaggccgagcccattccgccggcccagccggtcaatcccttcgatttcggcccggtctttcgcaaccgcgccgccatgggctatgtgctgggctatgccgcccatgtgtgggagctgttcggcgcccgctcgtggatggtggccttcctcgcctgggtgctggcctcgcagccgggggccggcgggccgtctcccaccaccgccgccaccatcggcgccctgctggccatggcgtcatccgtgatcggggccgatctggccatccgcttcgaccgccgccgggtctgcgccctggccatggtgtcctcggccctgctggcggcggtgatcggctttctgggcggcctgccctatggcatcgtcgtcgggctgatgctgctctacaacgtgctgatccagatcgattcggcggccttaaccaccggcgcggtgatggcggccgagcccgagcggcgcggcgccaccatcgccatccactccctgctgggctttggcgccggattcgtcggccccctggccttcggcatggtgctggatctggcgggcggaggaaactcgtccctggcctggggtctggccttcgcatccctggcggtggtggtcggactggggccgctggcgctgcggatgaaataggcaccgtccattggcgacaatgcaagtgggcttccgcccacaccggatcggggcgcccccgcccccctctattttattcataaaatcgaagggggcttggggcatcgccccaaatgggttcgggcgatagcccgacggccgctcacatcacccgcaaaatcatcaccccgcccgcgcccgcccgatagaccagccgccagggcagaccgggcagcggcagttcgcgggtgccgggcgccgttccctcacgtccccgttcggggaactcggccaggcaatcggcggaatcggcgatcaggcggccgatgcgcttggccgcctcgccgcccaggccgccgcgcagccggaacagatcggtgagggcggcatcggaccagcggatcatctcagcagcttccgggcgggccggattctccgtcgcccccccagcccagcagccagagcctgacccgggcatggtcggcggacaggccggggcgagcgccgaattcgccctcccccgccgccgcgatcaccgcccggtgggcggcgtccctgtcgtcctcgacatcgaggaagtggcgcaacgcccggtccagcagcgccgccgcatcaccaccctcgaccgccaggcgctggtccagccggcgggcgagatcgtcgtcgagaaccagttgaagcgtccggggcatgtctttctcctgcaagatggggaagtctacagcctcttgtgacacctgcccaataagcatacgctcatacttccggttgatcgccatggggggatgggacatgttcgaagcggctgaactggggcgcaagatctcgcgcgaggaattcgacgccatggcgccgggcctgcgcaccgagcttctggccctgcaacagcaactgcgcgaggcggactttcccgtgatcgtgctgttcgccggcgtcgacggggccggcaagaacgagacggtcaacctgctgaacgaatggatggacccgcgctggatcgtgacccgcgcctatggcccgccgtccgacgaggagcgcgagcgcccggaatactggcgctactggcgcgacctgccgcccaagggcaaggtcgggctgttcatgtcgtcgtggtaccaccacccgctgatcgaccgcgtcagcgacaagatcaccacgcccgaactggacgagcggctggagcgcatcgttcacttcgagaagaccctggcggacgagggcgccctaatcctcaaattctggatgcacctgtcccagaaggcccagaagaagcgcctgaagagcctggaaaaggacccgctcaccgcttggcaagtcaccaagcaggattgggaccactgggagatgtacgacaagttcgtcgccacagccgaacacctgatcatgcggaccagcaagggccatgccccctggcagatcgtcgagggcgccgatccccgctaccgctcggcggtggtgctgcagaccttgaaggacgccatcaccaagcatttcgcggcgcgggatgcggtcaagaaggtcaatgccgagatcaaggacaaggccaaagccaaggccaagaatagcaccgagcccagcattctggcgtcgcagccgtccatcctgtcctccctcgacatgaccttgtccatcgagggcgccgaatacaatcaggccctgcaggaacagcgcgcccgcctcgcccacctctaccacgtggcccgggaaaagggtgtctccaccgccctggtgttcgagggctgggacgccgccggcaagggcggcaccatccgccgcctgaccaatgcgctcaacgcccgggactatcaggtcattcccatcgccgcccccaccgaggaggagcgggcccagcattacctgtggcggttctggcgccatgtcgcccgcgccggccgcgtcaccgtgttcgaccgctcgtggtatggccgcgtcctggtggaacgggtcgagggcttctgcaccgaggaagcctggcgccgcgcctatggcgagatcgtcgatttcgaacagcagctcaccgatcacggtatcgtcatgtgcaagttctggctgcacatcaccgccgaggagcagttggcccgcttcaacgcccgcggcgagatcgaatacaagaagtggaagctgaccgacgaggactggcgcaaccgcgaacagtggggcgtctacgaacaggcggtcaacgacatggtcgagcggacctccaccaccaacgcgccctggaccctggtcgaggccaattccaagtcctatgcccgggtcaaagtcatgcgcaccgtcgccgatgccctggaggccgccctgggcaaagctggaaaaaagaagaaggattagaatggcaaacctgagtctttcggataggctgccctatctgactgatgtaataattccgaaataggtacttgactgccggtttcttcctacataaaaacccttacgaatgggagggagagtgcgcaaagcaccacctcgccttctggtaggggggttacatgaagatcgcaatccggctgtggctgatcgtcgccaccgcgctgtgtggcattgccgccgtggtggccgccagcttggcccagatgaaccacgacctgatggacgaccgcgaggtgaagacccgccacatcgtcgaggtcggccaatccctgctctcccattacgaggagatggagcgcgccggacgcctcagccgtgacgaggcccaggccgccgccatcgccgccgtgtccaagctgcgctacgagggaaccgagtatctctggattcatcgtctcgacgaatccgtgatgctgtcgcatcccaacgccaagctgatcggccagcccatcctggacatgaaggaccccaacggtctgttcctgttccgcgagatgaaccggatggtcaaggagaagtccgtcggcttcgtctactacatgtggcccaagcccggcgccaccgagcccgtcgcgaagctttcctacgtccagggcttcgccccctggggctgggtgatcggcagcggcatctacatcgacgacgtctccgccgccttccgcacccgcgccgtggaattcggcgccgcagcgctcggcatcctcgcccttgtctggctgatcgccgcctgggtgggacgcggcatcacccgtcccctgggcgacgtcaccggcgccctggaccgcctgaccagcgacgaccacagcgtggaaatccgccacaccgggcgcaccgacgagatcggcgccctggcccgtggcctgaaggtcttccagacccatatcgaagccgccgcccgtgccgccgaggaaaagctgcgccagcaggaggccgatctggcccgccagagccgcatcgcggccctgacctcggaattcgacgccaaggtggccggcgtgatcaagtcggtgggcgccgccgccgcccagatgcagtccaccagccagtccatgtcggccatcgccgaccagaccgcccggcagtccaccgccgtggccgccgccgccaaccatgccgccatgagcgtccagaccgtggccgccgccaccgaggaactgcacgcctcggaagcggaaatcgcccgtcaggtggaagtctccacctcgcgctcacgcaccgccgtccaggaggccgaacgctccagcgagatcgtcagcggcctcaattccgccgccggccgcatcggcgaagtagtggcgctgatcaacgacatcgcgtcgcagaccaacctgctggcgctcaatgccaccatcgaggccgcccgggcgggcgaggccggaaagggcttcgccgtggtcgccaacgaggtcaagaacctcgccaaccagacggcacgcgccaccgacgagatctcctcgcagatcggcgaggtacagtcggccgccaccctggccgccgaggccatcgccgccatcgtcaacaccatcgccgagatcgacgagacctcgtccgtggtggccatcgccgtggaccagcaatcggcggccaccaccgagatcgcccgctccatcgagcaggccgccaccggcaccgccgaggtctccaataatatcggcgaggtcagcgacgccgcccgccacgccggctccaccgcctccgaggtcctcgcggcggcggccgaactcaccggccaggccgacgcgctgcgcaccgaggtggagcagttcctgaatgccattcatcaggggcaaaggccgacgcaggcaccccatctgcatctggtggcggcggagtagcactccgcccctgccgggggaccccgcttcgcggcagggcgaccgcccagacccgttcggaggcacagcctccgaaccaccggttgcttcttatttcaatcgattaataagctgaagggttcgggaagctgtgcttcccgattgggggatcgggggcaaaagcccccgaagcggcgcatctccgcaccccgccccttacccttcgcgcgacagcacgaacaatccctggtcggcgaacagattggcgatgccctcgcaggaggggatcgccatggtcttgccgccgcggtccagggggatggagcgctcgaccttgatctgcaaatcgcggcacaggtccaggaagtccctgatggtgcaaaagtggatgttgggcgtgtcgtaccactcataggccagggtgtctgtcaccggcatgcggccatgggtcagcaggtgcaggcgcacccgccaatggccgaaattgggaaacgacacgatggcgcggcggccgatgcgcagcatgtgcgacagcacggtgcgcggcgcgtaggtcgcctgcagcgtctggctgaggatcacgtaatcgaaggcccccgagggataatccttgaggtcagtatcggcatcgccctggatcaccgacaggccgtgggagaccgccgccgacaccccggccatggacagttcgatgccgcgcccgtccacattcttggtgcggcccagccaatccagcagtgccccctcgccacagcctacgtccaaaacccgcgagccgggctcgaccatgtcggcgatcagccggaggtcgacgcgaagattgccgttggccacggtcatcatcggccggctccctcggtgcgcggcaggccgcgatgggtggcggcgccctccaggaaaccggtgagggtggcgtggaactcgggctcgtccagcaagaaggcgtcgtggcccttgtccgacttgatctcgacgaagctgacattggcggcgacggcgttcagcgcatgcaccaccgcccggctttccggggtggggaacagccagtcgctggtgaagctgaccacgcaaaagcgggtccgcgtgcctcggaaggcattggccagcacgccgccgctttccgccgccagatcgaaataatccatggcccgcgtgatgtagaggtaggaattggcgtcgaaacggtcgacgaaggtgttgccctggtggcgcaggtagctctccacctggaaatcggcgtcgaagccgtaggtgacggtatcgcggttctgcaggttgcggccgaacttctgatgcaacgccggctcggacagataggtgatgtgcgccgccatgcgcgccaccgctaacccgcgatgggggcgcttgccctcttgcaggtaattaccttcgcaccagtcgggatcggccatgatcgcctggcgccccacctcgtggaaggcgatgttctgggccgaatgccgcgccgccgaggcgatgggaatggccgagaacacccgctcgggatagacctgcgcccatttcagcacctgcatgccgcccatggagccgccgaccacgcaaaacagctggtcgatgcccagatggtcgaccagccgcgcctggaccttgaccatgtcgccgatggtgatcaccgggaaatccagaccccaggcctgtccggtggccgggttctcgtccacgggaccggtggtgcccatgcagccgcccagcacgttggagcagatcaggaagtagcggtcggtgtcgaacacccgccccggccctaccagctcgtgccaccaaccgggcttggcagtgatggggtgggggtcggcgacgtaatggtcgccggtcagcgcgtgacagatgagaatggcgttggacttgtcggcattgaggcggccataggtctggtaggccacctggatcggtcccagctcgacgccgcaatccagccgaatcggccggtcgcgccccagttcgaccttgaggccggcggggttggcggaggcagtgggaacgggctcgctctgggtcatcggatcacgcgccgtgacggggaatggattagctatggtcgcgggaggggactgtcaacgttttctttgatttccgcgccaagccgcactaaacctatcccccttggacccaccaattccggccccaaattccgccatgacccaggacagcgcagccctcgagcagctccgtcgtgaaattgatcgcatcgacgatcagttgcacgacctgctgatgcgccgcaccagcctggtgggcagcatcgccgccgccaagagcgaccggcgggtgacgctgcgccccggccgcgaggcgcagatcctgcgccgcctgctggcccggcatgaaggcgcttttcccaagctggccgtggtgcgcatctggcgcgagatcgtcggcgcgctgaccggacttcaggcccctctcaacgtggcggtccacgccgccgggcgctccaccgccgccatcgagctggcgcggaaccatttcggcgtggtggcgccgctgcacgccttccgcagccccggccaggtggtgcgcgccatcgccgacggcgtggccacggtgggggtgatcccgctgatccccggcaccgaggcggccgacgacgccgagccctggtggaccagcctgatgctggaaagcggcgacgcgccccgggtggtggcccgcctgcccttcgccccgacgctgccggtcaagggatcgggcgagcccctccaggccctggtcatcgcctgccgcgaccacgatgaatccggcgacgaccgcaccctggcggtactggagaccggccccgacgtcagccgcgaccgcctgcgcgccatcttgggcgccggcgggctggaaccggccgaactgctggccatccaccgtcatggcggccaatggctgcatctggtggagatcctgggccacgtcaccgccgccgatccgcggctgatggccctggtcgcccccaaggaccccgtcggccgcattgccgtggtcggcggttacgccacccccttcgcgcccgaggcgctcgtctgaccctttcgctggagattacatcgtgaccgcacccgcgccccgccccggcatcatggacatccgcccctatgtgggtggcgaatcggcgatcgagggcgtcgaccgcatcttgaagctgtcttccaacgaaggcgcgctgggccccagccccaaggccatggaggcgctgcgcgccatggcgcccgagatgcaccgctatcccgacggcggcgccgaggatctgcgcaaggccattggcgcgcgcttcggcctggacgcgtcgcgcatcgtgtgcggcgccggctcggacgagctgctgggcatcctctgccgcgcctatgccggccccggcgacgaggtcctgtattcggcccacggcttcctgatgtacgccatcgccgccaaggcctgcggcgccaccccggtcaccgcccccgaggtggacctgaccgccaatgtggacaacctcctggccgcggtgacgccgcgcaccaagatcctgttcctggccaacccgaacaaccccaccggcacctatctgccggccaccgaggtcgcccgcctgcgcgccggcctgcgtgccgacatcctgctggtcatcgacgccgcctataccgagttcgtcagccgcaacgattattccggcggcatcgagctggtggaagccggcgacaacgtggtggtctgccgcaccttctccaagatgtacgccctgggcggcctgcgtctgggctgggcctattgcccggagaacgtggcgggcgtgctgaaccgggtgcgcaaccccttcaacgtgggcgcccccgccctggccgccggcctggccgccttcaacgacaccgcctatgccgagctgtgcaagagccacaacgactactggctgccctggctgtcgggccagttggccgagctgggcctcaccgtggtgcccagcgtctgcaacttcatcctggtgcgcttccccaaggacgcgggcaaggacgccggcgccgccgacaagttcctgcgctccaagggcatcatcgtgcgcgccatgggcggctatggcctgggcgattgcctgcgtatcaccatcggcaccggcgaggaaaaccagctggtggtcgcggccctgaaagagttcgtgggagcatgacacaacccttgttcgataccgtctgtttcgtcggcatcggcctgatcggctcgtccctggcgcgggccatgcgcaagcatggcctggcccggcgcatcctgaccctggaccccagcgagaaggcccgccagacggcgctggaactgggcgtggtcgacgccgccagcgacaatccggccgccttgatccccgaatccgatctggtggtgatcggtgccccggtcggcgccacccaggcggtgggcgccgccatcggcccgcatctggtgcccggcaccatcgtcaccgacgtcggctcggtgaagctgtcggtgatccgcgacctcggtccccacatccccgacggggtcgaactggtccccggccaccccatcgccggcaccgagcattcggggccggaaaacggcttcgccgaactgttcgagggccgttggcacatcctgacccccgtcaccggcggcgaccccaaggctgtggacaaggtggccgagctgtggcgcaaggtcggctcccaggtggagatcatggacccccaccaccacgacaaggtgctggccatcacctcgcatctgccgcatctgatcgcctacaccatcgtcggcaccgccaacgacctggaaggccatatgcagcaggaggtgatcaagttctccgcctccggtttccgcgacttcacccgtatcgccgcctcggacccggtgatgtggcgcgatgtgttcctcaacaatcgcgaagcggtgctggaagtgatccagcgtttcaccgaggacctcaccgccttgcagcgggccatccgttggggcgagggcgaggtgctgcacaaacgcttctccgagacccgtgccatccgccgcgccatcatcgacgccaagcaggcgtaacgtgcccgtattggacaatgccccaagccgcctttgatttataaataaagggtggtttggaggcatcgcctccaagcggggccggggcggcagccccgacaggaggagcagccatgaccagccgcatcaccggtctcgaccacgttatcatcgccgtgcgcgacctggacaaggccgccgccaccttccgcgccctgggcttcacactggcgaccaagggcgagcacgccgagtggggcaccgccaattactgcatcatgttcggggatgattacctggaactgctggcggcggtgggcgagggcggaccggccgaccgggtgcgcacttttctcgacgacaagggcgaggggctgatgggcctggtgtggggcaccgaggacgcggccgccgacagcgcccgcctgggcgtcgagccgccgggcgatctgtcgcgcagcattgaaggcgacgtggcccgcttcaaggccggcattttgccccccgagaccacccctggcatcgcctcgttcctgtgccagcatctcaccccggaaaagctgcgccgcccggggtggaccgagcacgccaacagcgccaccggcatgctgtcggtcaccgcgctgatggccgagccgctggagctgatgcccgcctgggaccgattgatcggccccgccgccgccaccgccaccgacgagctggtgaccgtgcacacccgccacggcatgatcttcctctgcatgcccgacgacatcgggcaattgcatcccgaggcggacgaagaggatctgcccccggccccggccatggtggccctgaccctgcgcatcaccgaccgggccgccgccgtgcgggcgctgcaggcggccggaatcgcttatgagcgcgaccgccagggcaaggtggtcatcgcccccgaggatgcctgcggcgtgctgatcgagctgctggaataactattgggcactcacccaagcccatccggggcgatgccccggcccccctcttgattcaaagggaggcttggaggcatcgcctccaaccggggctcatctctccgagattggggggcgggagccccgcgcatggggctccctaagtcttacagcccgtaggcctgggccatcgccgggtccttggcggccaccgccttggccaggtcgaccatgaccttggcctgcttccaggtggcgtcgtcctgcatcttgccgtcgatcatcacggcgccggtgccgtcgggcatggcttcgaggatcttcttggcgaacagcacttcggccacgtcggggctgaacaccttcttggcgatgtcgatctgcttggggtgcagcgaccagccgccggcgcagcccagcaggaaggcgttgcggaactgagcctcgcaggccgcgtcgtcggagaaatcgccgaacgggccgtagaaggccttgatccccgccgactggcaggcatcgaccatcttggccacggtgtagtgccacagatcctgctggaacagggtgcggcccgccttgccctcggctgcgtcttccagcacgccatagaagggatggccgccgcccacgcgggtggtcttcatgccgcgcgacgccgccagatcggccgggccgaggctgatgccgtgcatgcgcgggctggcctgacagatggcggccacgttctccacgcccagcgccgtctcgaggatagcgtggatcatgatcgggcgcttgacgccgtgcttggcctccagctgggccagcagctggtccaggtaatggatgtcccaggggccttccaccttgggcagcatcaccacgtccaccttgttgccggcctcgccgacgatggcgttcatgtcgtcgaggaaccagggcgagttcaggcagttgacgcgggtccacaggccggtattgggattgtcccaggccttggccacctcgacgaagccggcgcgggccgcgtccttggcatcggcgggaatggcgtcttccagattgcccagcagaacgtcgacgttcttgcccatctcggcggccttggcccgcatcttctcgttgtgcggcgggaagaagtgaatcatgcgctcgaggcgcaccggcagttcgcgatagggcgcgggcgcgccgatggcgagcggctcgaagaacttgcggggcggcttgacggacatgaggcgcaatctccttgcggcgaaagacgatgggccgcaataatgcttcgtcgcgctgcggtgcacaaggggaaagctccacgggcacaccgtcataattggtcgcccacggccacatttcgggtattcccccccgggcttcgggcttataccatgggatggggtgagagctgatgacaggggccgccatgaatcaggacctgcgccactgcctgccggatcgcatcaaagccatcatgggcatgatgagcgcccaggccggcgacgagtccatcgccccgctgatcgccgacggctgccgctgcgccgagcagcgtccctgcatcctctggcgcgcatgccaaagtatacatcaggcctttgggccgacgttcgcgggtcacgcctgagccacgccaaatcatcaatttatgtataaagtcgtgccttcccccggcgaattccgcgggcgtagcatgacgttatgaacgccaatacgcacctctccggccgtcattccgccccgccgcccaacccggccagggctggcgcgtccatggacagcattgtggtttggctgcaggaccccgcccggcggctgcacggcatgatccgcgagattcccgggttcgccccgctgcggcacatatccctgtcggtctacgattccgaaaccgacatgctgtgggcgtttccctgccattgcgatgacactgcaaagcccgagatcaccgaaatcgatatgagcgacgtcccgtccctggtcctgctggccgacggcgaagagcctcgcatcgtcgctgacatggcagcttttggcgaccaagggcgctatcacacccacggggcgcgcaactcggacagccggtcctgcatgaccgcgcccatcaccctggacggccggttcctcggcttcgtcatcttcggggcggcaatccccaatttctttactccggcggcgcaggacacgctgctcaccttcaccgaagccttcggcattcttatcgaacgggcggcacagctttccgactgagccgggcggcgctatcctgaagggccatggccattccggagcgcgccttgccgatccttcccccgcccagcccccccatgttcttcttcggcaccctgatggacgaggacgtgctgaccaccgtcctgggccacccggtcacgccgcaggccctggagcccgcccggctgtccggctggcgccgcctgaccatcgccgggcgaacctaccccatgctggtcccccacgccaccgggacggtagacggtcttctggcccatggcctggacgagcgcgaccgcagccggctcgatttctacgaaggaccggaataccgggttgggctgctgccggtgcgggcggcggatggtgaggacgtgaccgccgaggtctatctctgcctaaacgacgtgattgccaaccggaacgaatggcgcctgggaacctggcgcctgcgccacaagcgggccgcgctggcccgcatccgcgccctaatggcgggatggcgggattagggcgaccggcgttcaatccgatcccggcctcccggcgaccattgaggggctggcatgaaccttagaccattgtacgtcatctttgacactcgatggtctaaaccaaaaccttgtcccgcagcagctcggcctgggccaggtccaccgagaccagttgcgacacgccgcgttcggccatggtgacgccgtacaggcggtccatgcgggccatggtcatgcggtggtgggtgacgatgaggaagcgggtcttggtgacgccggcgatgccttccaccagcgagcagaagcggtcgacattggcgtcgtcgagcggagcgtccacctcgtccagcacgcagatgggggcggggttggtcatgaacaccgcgaacagcagggcgagagcggtcagggcctgctcgccgcccgacagcagcgaaagctgctgcagccttttccccggggggctggccatgatctccagcccggcttccagggggtcggcggattcggtcagcgccagatgggcgcggccgccgccgaacagcttgacgaacagatcgcggaaatgctggtccaccgcctggaagctggccagcaggcgttcgcgcccctcgcggttgaggtcgccgatggcgtggcgcagcttggcgatggccgagaccagatcatccttttccgccaccatgccgccgattcgggcctccagttcctccacctcctgctcggcgcgcaggttgaccggacccatgttgtcgcgttcgcgcgacaggcggtcgaacttgcgctgcagttcctcgggatcgggacgctcctcctccaccagaccggccacctcgcgcaattgctcgggcgtcatgtccaggcgctcgccgatgcgcaccgccacggcgcgacaggcctgatcggcggccgagacggcggcctcgcggcggatgcgctcctcgcgggcattggccagcagggcctcggcttcccgcatgcggcggtcggcctcgcccagaagctgctcggcgccgatcagggcgtcggcggcggccttgcgcgccgcttccgccgcttccagccgctccagcagatcgctgcgtcgccgggcgaaggtgtcgggcagactggccagacgctccatctccagggcgatctcctcgcgccgctcggccagttcctccacatgggccttggccgcctcggcgcgggtccgccaggatttggcgtcgccgtccagcgcatccaggcggcggcggcgttcggcgccttcgcgggccacgccgtccagggccgagcgggcctccaccaggacggagcggcgctcggccagactggcgcgcagcagattgaccttgtcgcggccatcgctggactcggggaaggcggcgacggcaccccgcgcctcggccagatcggcctcggcctgggcgtggtcggcgctggcatcggtccaggcctgggtggcggccgccatgcgggtctcgaaggcggcgaagcgctgcgacagccgggcatgggagtcgcgggccttggcggcttcggcctcggcctgcttcaccgcctccttggcgcggcgctcggcctcggcggcgaattccacctcgcgggtggcggtctcgaccttttcctcggcctcctccacgcccatggaggcatcatcgagggaggcttcaagctcgcgcagccggttgcgctgggccagacgcagggccatgggcgacggcgcgcccgcgcgggccacatagccgtcccagcgccacagatcgccttcgggggtcaccagacgctggcccacggccagcagcgaccgcagagcttccccggcggcggcatccttgaccacgccgacctgggcgaggcgccgcgccagcggggcgggcgccgccacgaagcgggccagcggctcggcgccgtcgggcagcgccggcggatggtccagcggccccagatcctcccaatgcagcggcgcggacgggtccagcggggcggagaggtcctcgcccagggcggcggccaaggcgggttcgaagccggtgcgcgccgagacgtcgtccagcaccgggcggtgatcgccgcccttgccctgggccagcacctgacgcagcccatcggcctcggcctgcagccgcgaccgggcggcgctggccacctggaaggcgtcgcgggcggattcgcgggccgccagggcttccacccggcgacggtcggcgctttcggcctgttcgcgggattcctccaggaattccagcgtttcctccagctccatttccagggcggtgaggtccgagcggtcgatgctctcgccctcgatctcggccttctggcgctcggccacgcccaggcgctcggccatccggccgagccgcgtctcgcattcgcccagccggcgcagcgccgccgcccgctcggcatcggcggcggccacctcttccatcagggcggacagttcctgttccacctggaccaccgcctcggcggccagatccacggcctgttcggccagcagcttggcctcggcctcgccctcacccgcctcggccagcagggcgcgctcctcctccagccgggccagggctccgacggcatcggcggcgcgggcgtgttcgcgctggagatcggccccggcctgctccagccggcgctccaggtcgcggcgcagttcggccaaccggccttcctcggcctcgagctgctcgcgctcggccatggccttttgcagcagggcggcggcttcggcgtcggcgcggcgcagatccggcagtccggcggcggtttccgcctgcagcgccgaggcattggcggcgtgggaggtggcctcctccaccctcatctcggattcgcggaaggcggcgcgggcggcgtcgacggtgaccagggcctccagccagccgagatacagcacctgggcctcgacccggcggatctgctcggaaagggtccggtagcggttggcctggcgcgcctgcttttgcagcgacttcaactgctcgtccagggtggcgagcacgtcgtccagacgggacaggttgagttcggcgttcttgaggcgcagttcagcttcatgccggcgggagtacaggccggagatgcccgccgcctcttccagcagcgagcggcggtcggcgggcttggcgttgatcagctggccgaccttgccctggctgaccagccccgacgagcgcgcgcccgtcgccgcgtcagcgaacagcaactggacatcgcgggcacgggtatcgaggccgttgatgcggtagttcgagccattgccccgctcaatgcggcgcatgacctcgatctcgtcgcggtcgaactggggcggcgcggtgcgcgccgtgttgtcgaggcccagcatcacctcggccacgttgcgggccgggcggcccgaggtgccgccgaagatgacgtcgtccatctcgccgccgcgcatctgccgggccgaggtctcgcccatgacccagcgcagcgcttcgatgagattggacttgccgcagccgttggggccgaccacgccggtcatgccgggctcgatcacgagctccgccggatcgacgaaggacttgaagcccgacagacgcagcttggtgaactggatcacccgggacggcccctggaatgagactacttggacgcggccttcagcagcttgtccaactcgtcatagggaatggcgccggggatgaccttgccggcgatgatcagcgagggggtgctttccacgcccagcttctcgttgccctccttggcgcgctcgttgatggcgttggccagatcctggcgcttcaggcaatcatccaccttgtcctcgcccagaccggccagcttggccagcttcttcagctcgaccagcgggttctgcgagttcatccacttctcctgctgctccatgatcagggccagcaggccgaaataacggtccggcccggcgcaatgggcgatcatcgaggcgcctaccgacaggccgcgcggcccggtggggaagtcgcggtagatcagcttggccttgccggtctcgacccactcggatttgaacttgggcagcgtggtcttgtggaaggtggcgcagtgcgggcaggtggtcgaggcgtactcgatcaccgtgatgggcgcgtcgggcttgcccaggacctggtcgatggaatagctgaggtcggcggcggcggcggcggtctgggtcaccagaaacagcgcggcgacggcagcaagcagacgatagaacggcttcaccttgaggtccctccggaaatcggaaatccgggcgggatattaggggctcggccgccccggcacaaggcgtagggactcaataagacgacggagccgccgattgcggcgcggtcaccgccggcgacgcggccggggtctccggcggatcgggaacgtggccccacaggaacagcaccaccaccaggacggtggccaccaggacggtgatcacgaaatagcggaccagcccgtaatcacgggtcatgtcggcgaaatcgtgaaatgcgttcatgggccactccaggccggctcgcggcaagccattacagtatatgggaagcccttaggatttggttagggcaatcatttggccagccgccgcgccaatcgttcgagcgcggcgcgtagttccgggtcctcgacccgggctagctgctcgccggccgggatcgctcccgccggggcggcgggcggggccggcgcctgtgtcctgggcctgaccgaagcctcgggcaggggaccctggcgcagcttcaggcgggccaccgccttccagccgaaatagccgttgatccgctccagaaccagcggttccaggtgctgcatctccagggcgaaggcgccggaatccaccttgaccgtcaaggtgccctcgacccgctccttgggcgggaaccggatgccgagcggcagggtatggctggccaccgccgagccgacgatggccggccagtccaccaccagggcgccgccgacaaagccgtggcggccgaaaaccggacgcgtcacccggtcgctgggcacggcgatggagaccagtccgtgggtacggcgctcgtcggaaggcttggtcgctggcttgatttggggcttggtcttgctgtcggccatgtggcgagcatacccgacgcccgcgttttgcactatggttcgggcatgcctgccttcgaccccgcctccctgctgcttgcctggtacgaccgcgaccgccgggtcctgccctggcgctacgccccgggcgaggccgccgacccctatcacgtctggctgtccgaggtgatgctgcagcagacgacggtggcggcggtgattccctatttccaggccttcatccgccgctggccccgggtgggcgacctggccgccgccgccaccgaggaggtgatggccgcctgggccggtctcggctattacgcccgggcgcgcaacctgcacgcctgcgccaagctggtggccgagtggcggggcggacgctttcccgaggacgaggcgggcttgcggcaattgcccggcatcggcgactacaccgccgccgccatcgccgccatcgccttcggccaccgggcggtggtggtggacggcaatgtggagcgggtgatggcccgcatgttcgcggtgaccgacccgctgcccgccgccaagccgcgcctcaaggaattggccgccaccctgactcccgatgaccgggccggcgattacgcccaggcggtgatggatctgggcgccaccatctgcacgccgcgcagcccggcctgcggcctgtgcccctggcggcccggctgccgcgcccaggccctggggctggccgaatccctgccggccaaggtggaaaaggccgaacgcccgacccggcggggcgtggtcttctggctcaccgcccccgacggctcggtactgctgcgccgccgcccacccaaggggttgctgggcggcatgatggagtttccctccaccgactggcgggatgcggcctggagcctggacgaagccgcgccatccgcgccgctggcgcccaaatcctggcgattgctgcccggtctggtcacccacaccttcacccattttcacctggaactgacggtggcggcgggacgcacccctgcccagccggcggttcgtggtgtatggtgccccctggaccggctggaggaacaggcgctgcccaccctgatgcgcaaggtggcgcgtcacgccctggccaaggcttattgagggaatgacatcatgatgcgcccgctcgccctgcttgccgccctgacgctggccgccgccgcgcttcccgcctcggcccagatgcgccagccgggccgcccggcccaggagccgagcgccggcaacggggaactgagcgagcgcctgctgctgctgcctcccgccggctggcaggaaggcggcaccagccgcggcggcaacgcgctgaccacccagctgttcccgccgggccagaattccgaaaagtgggaccagatgctgtccatccaggtgatgggcgattccaaggccgacgcccgcgaccacatccagcggatcgtcgaggccagccgcgccaattgcgaagcctccggccccagcccggtcaccgagggcaacagcaacggctatcccgtctcgacgctgaccgtgacctgcaccaagggccgccagagcggcctgggcggtctggtggcggtcaaggccatccggggcaaccaggcgctttacgtggtccagcgcatctggcgcggccagcccttcgagcgcaattccaccgcgcccgtcccgcccgatatgctgaaggaatggtcccagtttctgcgcggcgtggcggtctgcgacgaagccgacccccagcgccacccctgcccgaagtaagtggttcaggcctcggcggtcaggaacagggtgcgctcggcggcgcggcgcttggtcaggccgggcagggccttcttcacgccgtccacggtggccttgtcccacttggggaattcatccgaggctccggcatagtcgccggcgttcagcttcttcagcagcgtcgagccctggaaggctcccgcccccagattgaagacgaaatcgcacagcgccgcatattgattgtcgttcagatccaccgtcaccgccttggtgacggcatcgccggcatgggccagatcggcggccagcaactcgtcggccctggcttcgtcgatggtcatgccgtccatgacgtcggggccggtatggccatagccgacggtcagcttgtgcgccgggcagagatagctcttgaggcgcagcccctccgaagccttggtgagggccagtccggcttcattgacggctcgtgtcatggcgcatcctttccttcccgattgcagcgtggacgctaccttacggaaatatgatcagccaagtccatgtcgctttagatgtggatgccattacttgcagagggttatgcccggccccgcctcggcgcagatcagcttgcggttgccgaaccgggccaccgtcacgccgtccatcttctgaatgatcagcttctgctcgccgatcaggcccatcatgttgccctggccgtcgcgggcgatggtcatggagcgcccggccagcttggaataggccaccccttcgccgccccgcaggatcaccgtctcgccggcatcggtgcaggacagggtctcgccctgggtgatgcacatgcccgcctgggccggagcggccgccagaaggacaagggcggccaccacaattatagtagcggcacgagcgccgcattgcccctcgccgggcgcgcccctccgggcgcttggccgccgcctccctgcggaccgtggtccgcccgggcctaagggcaatggcggcaggatgccgctggacccatggttcatctgcatcaatgcagctctgcccggatcttctggcgcagcacgtcgatgggcaggaagtcctcggacgaagcctggaagtgccagtaggtccagccgttgcaggccggcgcgccctggaccagggcgcccaccttgtgaatcgagccgcgatggtcatcggtgatcagggtgccgtcggcccgcaccttggcgaccttgtcgtgccgggtgccgccgaacagcaggtcgccggcggtgagcagcccgcgctccagcacggtgccgaacggaacccgcggctcggcccgcttggacggcgtcagcagcaaggagggatcggccaccggaatcaccttggcgatgcgatccttggcggcggcgatgtattcgggatcacgctcgcagccgatgaagttgcggcccagcttcttggccaccgccccggtggtgccggtgccgaagaaggggtccagcaccacgtcgcccggcttggtcgaggccatgatgacgcggtacagcagggattccggcttctgggtgggatgggtcttgcgcccggcattcctcaggcgctcgcccccggtgcacagcggcaaggtccagtcgctgcgcatctgcagatcgtcgttcagcgccttcatggtgtcgtagttgaaggtgtagcgggagtccgacgacttggcgcaccagatcatggtctcgtgggcgttggtgaagcgggtgcccttgaaattgggcatgggattgctcttgcgccagacgatgtcgttcagcatccagaaccccagatcctggaggatcgagccgacgcggaagatgttgtggtagctgccgatcacccacagcccgccatcgtccttcagcacccggcgcgccgccttcagccagtcgcgggtgaagctgtcataggccgcgaaatccgagaagcggtcccactcctcgtccacaccctccaccttggagttgttgggacgcagaagctcgccgcccagctgcaggttatagggcggatccgcgaagatcagatccaccgaaccggcgggcagggagttcatcatggcgatgcagtcgccggagagaatggtgttgagaggcagggtcatggcggaccgattcaaatgagttggagcactcaatttgagtcaaacatgagagtccgtcaagaacctgttggaatctaatgattcattgccacaggtagtggcttatccacaggttagaacagcatatattgggccacgggggcgaaggagcgtcggtgatggggggtgggaccgaggcgtttcagggcgtccagatgctcggccgtaccgtatccggcgttcctctcccagccgaattcggggtgggcgcgggccagatcggccatcatggcgtcgcgccgcaccttggccaccaccgaggcggcggcgatggacaatgagatgccgtcgccccccaccacgcagcggaccgggcagggcagccccggcggccggttgccgtcgaccagcgcatgggcgcattcccgccccagggcgtcataggcgcggcgcatggcgagaaacgtcgcctgcaggatgttgatccggtcgatctcctccaccgaagcctcgccgaagccaaggatggcggtggcgggcaccagttcggccagttcttcgcggttacgcttggatagcttcttggaatcgtccagccgctccagcagcgtcttgggcaggcgggcggggtcgaggatcaccgcggcggccaccaccggcccggccagggggccgcggcccacctcgtcgatgccgcagacgatgccgccgatctcaaattccagagccaggtccggcattggggtcatccctccaggaaccacgccgcaccagcacacgggcccgccgcgcggtgcgggcgaaagcgcgggcctcgtcgccatacagccgcgtgaccagatcgcggaacgaatggacatgcaccgccgccacccggtgcatgcgccgcatggtgaacagccagaacggcgacagcaccagggacagcacggtgaccgccaccaccagcttggtctcctgggcgctgatcagcttgaccgccttgccggtctcggccagcaggaacgagaactcgccgatctgggccagggccacgccggccaggaaggcgctgggccagtcctgccgcgccaggcgcagcgccgtgacgttcagcgccgtcttgaacagggtcaccatggccagcagggtgagaacggtgcccagattcttccagatgaacttgaagtcgagcagcagcccgatggacaggaagaacaccatcagcagcacgctgccgatgggctgggcacgcttcaacagcatgtcgcgctgggcggaattgcccagcaccacgccgcccaggaaggcgccataggccggcgacaagtccagcacgccggagatggcggcggtgccgaaacaccaggccagggtcgacagggtggcaaggtcagaatcgcgggaaagccgggcggtgatcggcaggtcgatgcggcgcttggacagccaccagaacagcagcaccaggaacagcaccgacagcaccacccgggccatgtcggcgggcagcagcgccttggtctcgaaggattccagcaccagcatcatgggcaccaccgccatgtcctgggcgatcaggatgccaagggtggtgcggccgaccggcgtgtccagctcgtccgaggattccagcaccttgatcactacggcggtggacgacaccgccacggcacagcccagcaccaccgccagccccaggctccagcccaggccgtgacgcagcagcagggccgtgcccacgctgccggcgatctgcagaaccgtggtgaagatggccgtcttccacacttcgagaaagcggatgatgtccagcttcatgccgatgacgaacagcagcatcagcacgccgaactcggccagggtggccacggcgtcgcggttgctcaccagcccgaagccgctgggtcccagcaccacccccgccaggatgtagccgacgacggccggctgcttcaggcgcgtcatcatcccgccgcacagcacggcggccagggcgacgatggcggcataggtcagttcgggatgatgcagttccatggacgcgttcttatcacgaaggcagcccccggtctaaagccccgatgtggcggaaatgtgacgacggctgcataaaaattatgccgaaagcaggtattgctcatattctgtgcacaagtagaatcgcgtaggcgcttattcgagactggcgcgttcaattgggggtttccatgcacagcggcctgaccatcgcacgactgaccaatctgtttgccgtctccctggtggccgggttcctggcgatcatggccgccgggtacctggccatcggcgaattgaaggtgggcggaccggtctaccagcggatcgtccagggcaaggatctggtggccgacatcctgccgccgccggaatacgtcatcgaggcctatctggagaccaatctggccctggccaaccccgacagcctgcccgagcgcaaggcggccctggccaagctgcgcaaggagtatgacgagcgccacgcctattggctggcccaggacatggaggccggcttgcgcgaccgcctggtggtgggggcccatgccccggccatgcgcttgtgggcggtgatcgatcagggcttcctgcccgccctggaaaggggcgagatggatgccgcccgcgccgccttcgccgagatctcggccgcctatgccgcgcaccgggccgaaatcgatgaggtggtcaagggcgccgacaagctgaccaccgataccgaggcctatgccgcccagcgcgagcagaccttcatgctgatcctgtggtcggtatcgggggtggtgctggccgtcaccctggccggggtcgccggcgtcatcttcggcatggtcgccccggtcaaggccatgaccggcgccatgaccgccctggccgacggcgagctttccacccgaattccctcggtccggcggggcgacgagatcggggccatggcccgcgccgtcgaggtgttcaaggagaacgccctcaagatcctgcaattgcgccaggaccaggccgaggccgaggcgcgggccaaggtggagcagcggcagtcgctgcaccgcatggccgacgacctggagaacaaggtcggcgaggtgatcggcgtcgtggcctccgccgccacgcaattgcaggccagcgcccagggcatgtcctcggtgtccgagcagacggtgcgccagtccagcgccgtggcggcggccagcgaacaggcggcggccaacgtctccaccgtggcggcggcgtcggaggaactgtcggcctcttcgcgggaaatcggctcccaggtcagcctggccagcgccatcgcccaggacgccgccagcgaggcggccaccaccaccgatctggtgcgcggcctggccgaggcggcgggccgcatcggcgacgtggtcagcctgatcaacgacatcgcctcgcaaaccaatctgctggcgctcaacgccaccatcgaggcggcgcgggcgggcgaggccggaaaaggctttgccgtggtggccaacgaggtcaagaccctggccaaccagaccgcccgggccaccgaggagatcaccgcccagatcaatcaggtgcaggaccgcaccgatcaggcggtggaggccatcgccaacatcgcccggaccatcgaacgcatgaacgagatctcgggcgccatcgccgtggcggtggaggagcaaggcgcggccacccaggagatttcccgcaacatccagcaggcccatgtggggaccagcgaggtggcgggcaacatcgccggggtcagcgacggcgcccaggagagcaacgccgccgccctgcacgtgctcgacgccgccggcgccctgcaccgccagaccgataccctgcgcggtgccctcggggagttcctgtccggcgtccgggccgcctccgcctcgtcgtgttgacatcggatcgcaatagacggaccgccccgtccggcgggagaaaggagaatcccgccggacgccaccccctcgggtgggaaaaatcttgccgcattgcagcaaccgaggcggcgcgatgcggcaaatcccctgatttcccaatgcaaatcagcatgctggccgagccggtttgagtccttgacacgggtggggccagaccttatggtgcccgcgcttttggcaccaaagggccagaagggggaattcgaggaccgaccctatggctgaccacgagactcccccgtctttcgatgacctcgacgcccgtctgcgcgctgcgcgcgctcgggaggaagaggactcgggtcgcggaccggaacggcgtggaacgccctccgggatgggcctggggatgcgcatcggcgccgagttggtggtaagcgtgctggtggggaccggcatcggctgggcgttggacgcctggctgaagacggccccctggctgatggtggttttcctgctccttggcggagcgtccggcgtcatgaatgtgtaccgccttatgcggggcatggacgagacggtgggcctgggccaagcgcagcggagagccgagggtgccggagaggatccggcgaaggaccattgagagaggcaaagcggtggctaatccgatcgagcaattcaagatccagccgttggttccgctcaaggtagggagcgtggacatttcgttcaccaattcctctgccatgatggtgctgtccatctgcctgatcaccctgttcctgaccctgtcggtccggtcgcgcgccctggtgcccggccgctggcagtccatggccgaggtgttctacgaattcatcgccggaatgctgcgcgacaacgtgggccaggaagggcggaagtatttccccttcatcttctcgctgttcatgttcgtgctgttcggcaacctgctgggcatgatgccgatcccggtgatcggcttcacctataccagccacgtgatcgtcaccttcgccatggcgctggtggtgttcgtcggcgtcacggtgatcggcttcgcccgccacggcacccattacctgcggatgttcttcccgcacggcgcgcccatcgcgacggcggtcatcctgatccccatcgagctgatctcgtacttctcgcgccccttcagcctcgccgtccgtctcttcgccaacatgaccgtgggtcacatcatcctcaaggtcatgggcgggttcgtggtgtcgctgggcgcgttctacctgatccctggcgcggttcccttcgccttcctgtcagccatcacggtgctggaattcggtatcgcgctgctgcaggcctatgtgttcaccatcctctcctgcatctatctgcacgacgccatccacatgcactaagtggctggccgggcggtttgccggcgggaacgtttcaagtttcatctgttccgttttgtcttgaaggagttgagtaaatggaagcgagcgctgctaagttcatcggtgccggtctggctgctatcggcatgatcggttcgggtatcggcgtgggcaacatctgggcgaacctgatcgccaccgttggccgcaacccctccgccaaggccaatgtcgagctgtacggctggatcggcttcgcggtgaccgaggcgatcgcgctgttcgccctggtcgtcgctctgatggtcctcttcgcctaatcgcgaagacgtatccgacggaacggtagggtccgcggcaggacgcagagattgcgccttgccgcggttcaccggccgctccgcttagttttttcgggccttccccgtttgggagctttgggatgcctcaattcgatcccaccttcttcgcgccgcagctgttctggctggcgctcaccttcgtcaccctgtacttcgtgatgtcgacggtggccctgcccaagatcggcgccgttctcgacgagcgtcagcgcaagatcgacgacaacctcgacaaggccgcccagttgaaggccgaggccgaggccgccgtggccgcctatgaaaaggccctggccgaatcccgcgcccacgcccagtcggtgatcaaggaagcctcggaccgcctggcggccgacgccgagacccgcaatcgggagctggctgcccgtctggccgatcaggtcaagtccggcgaggcccgcatcgccgaagccaaggacaaggctctggccaatgtccgtgacgtcgccctcgacgttgccggcgcgaccatcgcccgcctggtgggcagcccggccgacaacacccggctcgaggccgccgtcgccgccgccctcaaggagcacggcaaatgatttccgtcgcttacgccgccgacgccgcccacgccgccgctcatggtgcgttctacaccgagccccatttctgggtggacgtcgccttcatcctggtggtggctctggccttcaagccggtgtcgcgcgccatcgccgccgccctggacgcccgctcggccaagatcaagtcccgtctggacgaggctcacaagctgcgtgaggaggcccaggaaatgctggccacctatcagcgcaagcagcgtgacgccatgaaggaagccgaagagatcatcgcccacgccaaggccgaggccgagcgcctcgccaagcaggcggccaaggatctcgaggtttccatgaagcgccgcgagcagatggccatggaccgtatcgcccaggccgaagcccaggcggttcgggaagtccagaacctggccgtggacgtcgccatcggcgccgcccagaaggtcatcggcgagagcctgtcggcagctcagaccggctcgctggtcgataatgccatcaaggacctgccgggcaagctgcactaagcggcccgtatccggaccaaacgagcccccgccgggccaccggcgggggttttgttttggaggtcccttggggctcccgccccgatccccggttggaggcaacgcttccaagcctccctttcattcatgaatcaaaagggggaccggggcatcgccccggatgggcttgggcgatagcccaatagggcgctcacgccagatcgaacagcaggaactcggcgccgctttcactggtcagggtcagcatcgcctcgtcctccatggcggcgccgtcaccggcggccagcacctggccgttgagcaccaaagtgccggcgacaacctggacccaggcgccgcgccccgccaccaattggtgggagagggtatgcccggggctcaggatgctggcgtggatggccacgtcctgatgtaggaccaacgagccgtcccggccgtcccgcgacgcaatcagccgcagccggtcgcgcttggactcgtcgtcgaacaccgtctggctgtagccgggagtcaggcgctgcgcctcgggcagaatccatatctgcagcagatgcagaatctggtcggccagggggttcatctcggaatggcggataccggtgccggcggtcatggcctgaatctcaccccggcgggtgatgccgtgggctccggtgctgtccttatgctccaccgccccggcgatcacataggtgaggatctccatgtcgcggtggggatgggtgtcgaagcccgtttgcggcgccacccaatcctcgttgatcacccgaagcgcccgaaagcccatctgggccgggtcgaaatagtcggcgaacgagaaggtatggcggctgtccagccagccgtgattggcatgcccgcgctgggcggagggacgaaggcggagggtcatggtcgttctccaggtgaagggcgtcactggatcaacacataggccctggaggtaaattcaacaatcaccgccattggaacaatactgttgcagcaacagaaacctcgtgcccattgactccgccggccttgcccggctataaactgaactgaacggtttagttttggaactcccatgaaaaaacccatcgccatcgccgccgccctcgtcctggtctccttcggaagctggagcgcctatcgctggtcccaggaatggcgctggatggaatccaccgacgacgcctatgtggacggcgacatcaccaccatctcgcccaaggtggcgggacacgtggtggaactgctggcccgcgacaaccgcgccgtggccaagggcgacgtgctggtgcgcatcgacgagcgcgattaccgcgcccgcctcgacgaggccgccggccaggtcaaggcccgcctcgcccaactgattcagatcgacgaccgggtggcggtgcaggaagccgtcatcacccagtccggcgcgtccatctccgccgcgcgggccgaaatggtgcgggccaaggccgattacgagcgctcccgcgccctggtgcgcgaggattacgtcagccgccagcgcttcgacatcacccaggccgacgccgcccgcgccgaggccgggctgaccggatcgggggcgggcttgcaggcggcgcggcgccagctttcggtgctggcctccgagcgcaacgtagccctggcccagttggagcaggccaaggccaccctggtggtcgccgagaccgagctggaagccaccaccatccgctcccccgtcgacggggtgatcggcaaccgggcggtgcgcgacggccagtatgtgcgccccggtcagacgctgctggcggtggtgcccctgggcaatgtctggatcgacgccaatttcaaggaaacccagatcggccgcatgacgcccggcaaccgggtggagatcaaggtcgacgcctttcccggcgcggtgatcggcggcagcgtcgacagcttcgccccggcgtcgggcgccaagttcagcctgctgcctcccgaaaacgccaccggcaacttcaccaaggtggtgcagcgcatccccgtccgcatccgggtcgaccaggacagcccgctggcgggacagttgcggcccggcctgtcggtggtggtcaaggtggacacccgggaccaggggaaatgaccacgccgcccctcaacccccatgaccgggtggtgacgccccgtgactgggtcggcttcatggccatggtggtggggatgttcatggccatcctcgacatccagatcgtggccagctccatcgcccagattcaggcgggcatctcggcctcggccgaggagatcagctgggtgcagacttcctacctcattgccgaggtggtgatgatcccgctgtcgggctggctggcccgggtggtgtcgacccgctatctgttcttcgcctcctgcgttaccttcacggtggccagcgcggcctgcgccgtgtcgtggagcatcgaatccatgatcgccttccgcgccatccagggattcctgggcggcgccatgattcccacggtgttcgccacctcctacatgatcttcccgccccgccagcaggccaccatgtcggtggtcatcggcctgaccgccaccatggcccccaccatcggccccaccctgggcggctggctgaccgagacctggagctggcattggctgttcctggtcaatgtggtaccgggcgtgctggtggccaccctggtctacctgttcggccgcaaggaagaaccgcggcttcacatgctgaagggcttcgacatggcgggcatcgccctggtggcggtgttcctgggcgccctgcaatacgtgctggaagaaggccccggcgacgattggttcgaagaccgccgcatcgtgctggtgtcgctgatctcgctcctggccgggctgggcttcgtctggcgcgagttgacgtccgagcatccggtggtcgacctgcgcgccttctccgacagcaatttcgccgtgggctgcctgtactccttcatcatcggcattggcctatacggctcggtctatgtcatccccctctatctcgggcgggtgcgcggctattccgccctggaaatcggcctgaccatgatggtcaccggcgccttccaggcgctgtcggcgcccctggccggcaatctggcccgccatgtggacctgcgctacatgctgggcatgggcctcgccctgttcggcggcgggctgtggctgaacagcgccctgacctcggaatggggctattgggagatgttcctgccccaggcggtgcgcggattgtcgctgatgttctgcttcgtgcccatcaacgccgtggcgctggggcacctgccccaggacaaggtccagaacgcctcgggcctttacaatctcatgcgcaacctgggcggcgccatcggtctggcggccatcaataccgccctgacccaccggcttgacctgcatctcctgcggctctcggagaccctgaccgccgcccggggcgccgccaccggcatgctggagggcctgtcggcccggcttcagcccctgctggacggcggcgccgaccgggccgccctcaagctcctgtcgcaactggcgcggcgcgaggccatgaccatggccttcggcgacgtcctgatgctgatggcggcggtcttcgccctggggctgctgctgctgccgctgctgcagccggtccgccatcccagcgcgggaggtgacgggcattagaaccattggcaatcgtagcggtggaatcagatgccacttccatgcatgattggaatcaagggagctgccaggaccgccacagaagcggccggccatgaacgtcatacggggggagcagtgcccacctcacgcaataccgaatccgcgcacgtctttgccgtgcggctgatgcagcatcttgtcgtgcccactttcgtgctcaatgccgaacggcgggtgatcatctggaacaaggcctgcgagcgcctgaccggcgtgcccgcccacgaagtgatcggcacatccgagcactggcgggccttctacgaccaggagcgccactgtctggccgatctggtcctgctggaccggccggactccatggatgagctttacgtcacccatgccgagcccggcgacagcacccaggggctgagggccgaaaactggtgcgtgatgccccaggtcaagaagcggctgtatctggccgtggatgccggccccatcttcgacgaggacggcaccctgctggcggtggtggagaccctgcgcgaccagaccgagcagaagctggcgcagatggcgctgcaaagcctggcggtcaaggacgggctgaccgggctggccaaccgccgttccttcgacgagaagctggaggccgagtggctgcacaaccagcgcgaaggcaccagcatggccgtcctgctggtcgatgtggaccatttcaagctctacaacgacacctacggccaccagaagggcgacgcctgcctgaaatcggtggcggcagtcctggaccagcaggtcttccggccgtccgatctggccgcccgctatggcggcgaggaattcgcggtgatcatgcccaacaccgccctggagggcgcgctgcacgtggccgaccgcatcatggaggccatccgcgagttgaacctgccccacggcgccagcctgaccgccgagcgcgtcaccctgtccatcggcgccgccgccttcacgccgtcggacgaacgccgggccgaagacctggtggccgccgccgacgccgccctgtaccgcgccaagcaccaaggccgcaaccgggtggtctgcaccgaccggctggcggaactggtggaggcttaggagggatcagatcctggggctatcgccccagcccccatttggaggcttccgcctccaaacctcccctgaatttataagaaaaaagggggccggggttctccccggtgggtttgggcaaagcccaattgcgaagcaataaatcctaaggcagcccctacgggcggccgccccgggccgccttgatgaaggcgcggatcttgtcggaatccttgatgccgggggcgctttccacccccgacgagacgtcgacggcggcggcaccgctgatgcggaccgcctcggccacgttggcgggggtcaggccgccggccagcatccagggcaggccccatttgcgccccgtcaggatggaccagtcgaagctgaccgcgttgccgccgggcaggaccgcgcccttaggcggcttggcgtcgaacagcaggcggtcggccaccgccagatagggctcggcggcgtcaagatcggcggcgtccgacaccgacagcaccttcatgacgggcaggccgtattccaggcggatggcctcgacccgctcgggggtctcgtgcccatgcagttgcagcaggtcgagccgcacccgggtcagcaccgtgtccagggtggcatcgtcgggatcgacgaacaggccgaccttggtcacgtcaccgggcgcgaactccaccagttcggcggcacggtccggggtgacgttgcgggggctggggggaaagaacaccagaccgacgtaatcggcgccctcctcgatggccacgtccatagcgtcttcatcggtgatgccgcagatcttgacctcgaccggcatggtgctacagccccagttcagccttgatccgcccggctgcctcggccggatcggcggcggcggtgatggggcgcccgatcaccagcacgtcggcgcccttggcgcgggcctcggcgggggtaaggaagcgcttctggtcgccggcctcgctccaggcggggcggatgccgggaatgaccagcttgaaatcgggaccacacagggcgcgcaccgcctccacctcgaggggcgagcagacgatgccggcggcgccgctgtcctgggccagggtggccagacgcttgacctgatccagcaccggacgctcaaagcccacctgctcggccccggcctggtccaggctggtcagcacggtcaccgccaccacggcgggcggagcgatgccgagtttggccgcctcgtcattggccgcgtccacggcggcgcggatcatggcggcgccgcccgaggcgtgaatggtggtgatggcggcgcccaggcgcaccacgcccttcatggcggcggccacggtattgggaatatcgtgcagcttgagatcgacgaacagcggcatgcccaggccggacaccgcctccatgccggcggggccgttggcggtgaagtattccaggcccagcttgaagccgccgacctgccccttcaggcgttcggcaagggcgatggcgcgggcggcttcggtggtgtcgatggcgacatagacgggattgatcacggggtatctacctcagacttgagactgggtcttttcggcggcggccagcttgcgctgcagcgacccggcgcgcaggcgggccttcagccccgaggtccagcccagcaggaacccggcggtcaggcccaggcccagcggcaccagcaccgccagataggcgggcaggtcgacaccgaacggcaggggccacaggtcgaaacgaatctccgcccggttggcgacggcgaacaccgtcaccagaacggccaagggaaggccgatgatccaggcgaacagcctcacgatccgccgccgacgttaagcttctcgcgcagctgcttgccggtcttgaagaagggaaccgccttgccgtccaccgacaccgtttcgccggtgcggggattgcgaccgacgcgcggatcgcgcttcttcaccgaaaaggcgccgaagccccgcagctcgacccggtcgccccgggccagcgccgaggcgatctcgtcgaagatggtggtgacgatgcgctccacatcccgctgatagagatggggattggcctcggccaggcgggcgatcagctccgacttggtcatggatttcacgtccttgcttgtgttccagcttgggggccagcatgccgaagccccccgcccccgtcaagctcgactctgggggacaagtctctgagtgagaacgatttttagctcttgggctcgtcctcggggggcagcaccacttcccaggtgccgtccaccagccggcaggccaccacctggcgggaataggcgctatcggcctcgccggtcttctgggccgactggatcaaccggcggcaggcccgcccgccgccatcggcccagccctcgcccagaggcagcaccgcgccctccaggccgcgggccgcccaacgggcttccttgccgctctccgccgcctcgacggtcgccgccgaccacagccggttggggtgcggatcgaaatagccgccgatcatggtgcccgccgccgcgccagccacggcgcccacgggggtgaaggtgctggccagatggggcgcgccaatggccgccgcccgcccgatgccgccgccgaccaccgcaccggccccggcgccccacaacgccccctcggtgggattctcggcgcagccgccaagagccagcaggcacagcaaagcgggggcaagtgagcgcatggctataatccttcgttgcggaacggccgcgacagcagggcgcggatggcgtcgtccaagctttggccaccattgatcaccgcatcaccgccgccgagatgggcatctcgaccccggtgcgcccggccatgtcgaccacggcgccggcgctgtagacgccttcggtcaccgaatggcgctcgcccaggatgtcggccagggcgcggccctcgcccagggcgaagcccaggaatagttgcgcgactgggtggacgaggcggtgaggatcaggtcgcccagacccgacaggcccatcagggtctcgggccgcccgcccttggccatggccaggcgggtcatctcggccagcccgcgggtgatcagggctgcgcgggcattgtcgcccaggccgcgcccctcgacgatgccgcaggcgatggccagcacgttcttgacggcgcccccgatctgagcccccaccagatcgtcggacagataggggcggaagctggcggtgcccagtgcctccaccagcttgcggcccagttcgggcgcggcgcaggccagggtgatggcggtgggcaggccccgcgccacctcgatggcgaaggtggggccggacaacacggcgatgggcgcctggggcagttcggccgcgattgcatcctgcatcagggcgcaggtggacagctcgatgcccttggaacagatgacggcgggaacaccggcccgccagtgcggcgccagggcgcgggcggcggcgcgcaggtgctgggcgggcgacaccagcagcaccgcgtcggcatcggccgcatcggccagatcgacggtggcgcgcaaggcgggatcgagatcgattccgggcaggaagtcggagttgacgtggcggacattgatgtcgtccaccacctggggctcgcgggcccacagcaccacgtcgcgccccgcccgccgggcggtcagcgccaatgccgttccccatgcccctccgccgatcacaccgacttttttcatgaagcccccgccattgccgtcccccggtttaccccgatggcggagcgcgggcaagcgatcacagcgtcttgtgggttccgtcgcagagcggcggcgccttgctggccttgcagccgcagaaataagcggtgcccgccttgtccggcgtataggccaccggggcgaggccggttcccttgtggctgccgtcgcagaagggctgagccttggagcggccgcaggcgcaccagtggtaagtcttgcccgcctcgacggtaacgggatagggcgccttctgggcgatgacgggatcggtcatgggcgcatctcctctctgccgcagccccatacatgggcatgcggcagaggggaaacaatcaggcggcctgccccttgatcttggcgatgaagccgccgatctgggcttccaggtcgtcggcccgcgccgccaggctggcggcggcggcggagatctcgcgggcctcctggtcggtggtctcggcggtatccttcacataggccaccgcctcggacaccgacgcggtgccggtagcggcctcctggacattgcgcgagatttccatggtcaccgcgttctgctcctccacggcgccggccacggcggtggaggtctcctggatggtgccgacgatctgggcgatctcgcggatggcggcggcggcgccttccgaggccagttggatctggctgacatgggccgagatttcctcggtggcccgggcggtctggttggcgagggtcttgacctcgttggccaccacggcaaaacctttccccgcctcgcccgcccgcgccgcctcgatggtggcgttgagcgccagcagattggtctgcgacgcgatgtcctgaatgagggacagcaccgagccgatctgggcggcggcatgacccaggtcctgcaccgtctggtcggtgcgctgggcggtgaccatggcctcggacgaaatggccgtggcgcgggtggtctgcatgttgatctcgccgaaagacgcggcaagctcctcggcggcgccggccaccgactggacgttgaccgaggcctcctcggcggcggcggccgaggtcatggcctgctcgacggtctgggtggcgttgttcatcagccggtccgagctttggcgcagctgggtcgaggcggacgacacctcctgcaccaggacacggacattctgctcggcgaagttcaacgcgtcggcgtcccgccccttcatcagatccagggaggtgttgatgatcccggcatagcgggcaaagtcgccgcgcaagccggtcggaatgatcttgcggaagtactgccgctggttggcgtgctccatggccgcctgggattcgcggcaataggcctcggtcaggtccagcagccggttgatggagcgcagcatctggccgatattgccctggcccttgatgtccatgatgcggacgccgagattgccctgggcggcggcggcgcagacctgggcggccttttcgatgctggcgttgctgcggttgagcaggccgacggggatccaggccgggatggccaggaccacggcaaagcccgccgccacccagttctgcagcagcagggcgacgagaaccagggcaagggccagcccgaaggtgatctggcaggcccgccgggccttagagaccgaggacaaattctgcatagggctttccttcgcgcttcaactggtcgaccagggcggcgaacgccgcctccatgccctgcttgcggtcggcggcggcctcctcgatcttcagcaggctctggtacaggggctgaactttggcaagcgcgtcgcgacgcggcacgcggcgattggaatggtagccgacgatctggccgtcgggaccgaaatccggggtgacgtgggccaggacccagtaatgctcgccggtcttggccagattgaccacataggcgaacagttccttgcccgaggcgatggtgtcccacagcagcttgaacacgcagcgcggcatctcgggatgccggatcatgctgtgcggctggccgatcagttcggcctcggtgaagcccgaaacgctgaggaacacgtcgttcacataggtgagacgccctttggtatcggtcttgctgacgatgatttcgtcctcggcgaaagtccgctcttttcccgatggctgaatggtcctgctactcactcgcctaccccccccttacgacgtagttcccgcacaccctgtcatgagaatagatatcaacaggataataacaaatcaacacgctccgtgtatcttcgtatttctttcgtttaaaatttctttccactcgcttggcgagaacgcgccttcaactcagcggataaccccatgtcgcggcatgcagcccgaggttccccgccggtccggcggcgcggcgaccgccggaccggccaagaaaaccgtcctcaccacaaaatctctcctcaggggcggcgctttctgctttattggcgcctttccgccgcccaaggtccagaaacaacgccatgcaaagcctgaacacctaccgcgcgggtcccgacgaacgcggccatttcggcatcttcggcggccgttacgtggccgaaaccctgatgcccctcattctcgaggtggagaaggcctacgccgcggccaaggccgatccagccttccaggccgagttccgccggctgctgtcccaatacgtgggacgccccaatccgctgtacttcgcgccgcgcctgacccaggccttcggcggcgccaaggtgttcctgaagcgcgaggacctcaaccacaccggcgcccacaagatcaacaactgcatcggccagatcctgctggcccggcgcatgggcaagcagcgcatcatcgccgagaccggggccggccagcacggcgtggccaccgccaccgtctgcgccctgttcggcatgcaatgcgtcatctacatgggctccaccgacatcgagcggcagatgcccaacgtctaccgcatgaagctgctgggcgccgaggtccgtccggtcaccagcggcgccgcgaccctcaaggacgccatgaacgacgcgttgcgcgactgggtctccaacgtcgccgacacctattacctgatcggcacggtggccgggccgcacccctaccccgccatggtccgcgacttccagtcggtgatcggcgaggaagcgcgcgagcagatgcaggcccaggaaggccgcctgcccgattcgctggtggcctgcatcggcggcggctccaacgccatgggcctgttccatcccttcctcgacgacagcagcgtgcgcatcatcggcgtcgaagcggccggtcacggcctggacaagctgcacgccgccagcctgaccggcggcaagccgggggtgctgcacggcaaccgcacctatctgctgcaggatgccgacggccagatcgccgaggcccattccatctcggcaggcctcgactatcccggtatcgggcccgaacattcctggctgcacgaaagcggccgggtggaatacgtctcggtcaccgatgacgaggccgtggccgccttccagcaatgcacccgcctggagggcatcattccggcgctggaatccagccacgccatcgcctacgcctcgaagatcgcccccgccctgcccaaggaccacctgatggtggtcaacctgtccggacgcggcgacaaggacgtcagcaccatcgccaaggcgctgggcgacgagcacctgggaggactcgtctgatgtcgcgcattgccaagcgtttcgccaagctcaaggccgagaaccgcgccgccctggtgaccttcatcaccgccggcgaccccgaccacgccaccagccaggccctgctcgacggcatgccggcggcgggcgccgacatcatcgagctgggcatgcccttcaccgatcccatggccgacggccccgctatccagctggcggcgggccgcgccctggcggcgggcggatcgctccgccagacgctggagatggtcgaagccttccgcaagaccgatgccgagacgccgatcatcctgatgggctactacaatcccgtctatgcctggggtgcggagaaattcgccgccgacgccgccaaggccggagtggacgggctgatcatcgtcgacctgccgcccgaggaggccgacgaactggtgccgttcctgcgccaggccggcatcgacttcatcgtgctgaccacccccaccagcgatgacgcccgcctgcccgtggtgctggccaatgcatcgggcttcgtctactacgtgtccatcgccggcatcaccggcaccgcctcggcggcccaatcggccatcgacgaggcggtcgcccgcatccgccgccataccggcctgccggtctgcgtcggcttcggcatcaaggaccccgcccaggcggccgaagtggcacgcgtcgccgacggcgcggtggtgggctcggccatcgtttcggtgctggccgacaatatcggaaagcccggcgccgtttccgccccgctggccctggtcaaagacctggccgccggtgtgcgcggcgcccggaactaggagcattttccatgaattggctgaccaatctcgacaacacccggcgttcgctgaaagagcgcctgatcggtctggtggcgcccaaggaggtgcccgacaacctgtggctcaaatgcccgggctgcggccacatgatttttcaccgcgacctggagaagtccctgaacgtctgccagcattgcggccatcacctgcggctttcggtcaagaagcgcctcggcatgctgttcgatgacggccagttccagcgcatcgaactgcccaaggtcgccgacgacccgctgaagttcaaggaccagaagcgctattccgaccggctcaaggacacccgttccaagaccggtgagaccgacgccatcgtggtggcccacggccgcatgggcggcatgaacgtggtggcggcctgcttcaactttgacttccagggcggctccatgggcgtcgcggtgggcgagggcatcgtggcggcggccgagctggcggtgctgcaggatgcgccgctgatcgtcattcccgcctcgggcggcgcccgcatgcaggaaggcatcctgtcgctgatgcagatggccaggaccaccgtggcggtggacaaggtcaaggagaagcggctgccctatatcgtgctgctgaccgatcccaccaccggcggcgtctcggccagcttcgccatgctgggcgacatcgccatcgccgagcccggggcggtgatcggcttcgccggtgcccgcgtcatcgaaagtaccatccgcgagaagctgcccgaaggcttccagaaggcggaatacctgctggagcacggcatggtcgacatggtggtgccgcgccgcgacctgcgcgccaccatgatccgcatcctgtcgctgttgaagaaccgcggggcggccggcgacctgctgtccctgcccatcgatacccccgacgccgtcgatcaggactgagcggagcgtcacgggactggaattcccgggtgcggccccttatactagcgcgaaggtaataccgaggccctgggcctcggtattgtcgtttgtgggcgtgtctgcgaggtccccgccttgaaccgggttgaaaaggacgtgctttccctggccctgccgctgcttcttctggtcgcggcggcggcgctttgcggcttggcggtgcgcatcgtcccgccgggacgaatcttcgacgacccggcatcctacctggccatccactccgctctggaactgatcagcatcaccgtgtcgctgatggtgttctcgctcggctgggcggtgcgccgcaccgaccccaaccagcggaacctgatcctgggtctggccgccctggcggcttcggccatcgatgtcttccataccctctcctacgccggcatgccggatctggtcaccccgagcagcccggaaaaggccatcaatctgtggcttctcggccgcctggccatggcggtggggctggtcctggccgttatcgtcaccaccgaccaccagtggcgtgatgccacgcggcggttctggcttggcggcgtcgcgctggtcaccacgacgctggtcgccatcgggctggttcaccccgaatggttcccccggaccttcattcccggcagcggcctgaccccgttcaagatcagcgcggaatacgtcctgtccgtcgcctatgtgggggccgccagtgccatgtatctgcggtttcgccgcacgggggaccccaacgagctgaagctggccgctgccgcctggattatggccctatcgggcgtgctgctgaccctttacggcgatgtgggcgacctcttcaacctggcgggccacctgggcaaggcgctggcctatctgctgatctacggcgcgctgttcgtctcgggcgtccagactccctacaccgccctggccaaggagcaggccctgctgcggaccctgatggattcggtccccgacctgatcttcttcaaggacccgcaatcacgctatctcggctacaaccgggcctttgcgtcctattgtggccgcccggaagccgaaatgatcggcaagaccgacgacgagttcgcgccgcccgaagtcgccgagttctaccgctccaaggatcgcgcggccatggcggcgggacggcccaccaccaacgaggaatggatcgactatcccgatgggcggcatgtgctgctggaaaccatcaaggcgcccattcacgagaacggcggcaccctgatgggcatggtgggcatcagccgcgacatcacccggcgcagttccgccgaggaaaagctgcgccgggccctgtccgacctggagatggtcaccaccgtcgccgcccacgacctgcaggaaccggcccggaccatcgccagcttcctgcaattgctggagctgcgctaccgcggcaagctgggcgaggatgcggaccagtacatcgcctatgccgtggcgggggcccatcgcatgcgggaccagttggcggggctgcaggaatacaccctggtcgaccagggtcccgcgttctttccgccggtggatgccgccgagatcgtcgccgccattctggaggcctggaagcccaagctggacgaggcgggcgccgtggtcagcctgggcagcctgccggtggttcaggccaatccggaccagttgaaggccctgttccagcacctgatcggcaatgccctcaaattccgccatcccgatcggccgccggaaatccggctcagcgcggcacaccaggggggcacctgggaattttccgtcaccgacaacggaatcggtgtcgaggaagcctattgggacaagatcttcatggtgttccagcgcctgcacccgctcagcctctatgagggaaccgggataggccttgccatctgccgcaagatcgtggaacgtcacggcggccgcattcgggtggtgtccgtccccaaccagggcagcaccttcagcttcaccattcccgaccgcgcctgaccctgccgccacgccaatccagcgaccatgatcgaccgcattctcgaccgcctgacccggctgcaccccaaagtcatcgacctgtccctggagcgcgtcctcgggctgctcgacgccctgggcaatccccaggacaggctgccgccggtcatccacgtggcgggaaccaacggcaagggatcgacggtggcgacgcttcgcgccctgttcgaggcggcggggctgcgagcccacgtctatacctcgccccatctggtgcgcttcgccgagcgcatccgcatcgccggcgcattgccctcggacccgcaattgctggccttgctggaagaggtggaagccgccaacgggggcaaccccatcaccttcttcgagatcaccacggcggccgccttcctggcctttgcccggagcccggccgagatctgcatcctggagaccgggctgggcgggcggctggatgccaccaacgtggtcgagcgcccggcgctgaccgtgctgactcccatcgccatggatcatgagagcttcctgggcggccgcatcgaggccatcgccgccgagaaggccggcatcatgaagcgcggcgtcgcctgcgtcgtggccaagcaaggccgcaaagccgccaaggtgctcgacgcccgctcgaccgaactgggcgtgccgctgatcaaggagggcgagcacttcttcgcccgcaccgcctccgatggcgggctgatctatcgcggcccgtcggtggaatggagcctgcccgcccccgccttggccggagcgttccagtaccgcaacaccgccctggccctggcctgcatcgagcgcctgtcgcgcaccgcgccggttcccgccttccccgacttccccccgggcgccctgggcctcggcgtccgctcggtggaatggccggcgcggctgcagcgcctgacccaggggccgctggtcgacctgctgcccgagggctgggagctgtggctggacggcggccacaatccccacgccgccgaggccatcgcccagcatgcccgctcgtggcgggacaagccgctgatgggcgtgttcggcattctgtccaccaaggacgtggacggctatctcgaacccctggcggcgcgctttcacaccctgcgcaccgtggccatcccgggagaggcggcatccctgtcggccgaggacggcgccacggcggcgacccggcatttctgcctggacgccaagcccgcgccgtcggtggaggcggccatcgccgagctggtggcggccggttcggcccccgcccgcatcctgatctgcggctcgctctatctggccggaacggtgctgtcggccaattcctgagcccgcccgaaacgctgttccagcgttgcgcgggtcgccgaccagacctcgcccagcggctggatatgccggcgtacctcgtcggcacggccatcgcgggcggcgacctcgatggcggcggcgagatcggcgagagacgcgcaacccgccgtcccggccatgctcttgagatcgtgggccgccatgtgcaggcgcagcagatcgccggtttcctcggccaggatgcgacaggccgcctcggcatgggtgagaaaggcgctgaccaggctggtcatgccctccggccccagataggcgctcagttcggcgaagggcgctgtctgtccggccgcgggcgtcgccccgaccggaccacccgccagcacatcgccgatgacccggaacaggatggccggatccaccggcttggccacatgggcgttcatgcccgcctcccggcaccgttcggcgtcgccgcgcatggcgttggcggtcagggcgatcaccggcacgtcccccgccggagcgggcagcgcccggatgcgcgagaccgcctccaggccgtccatcaccggcatctgcatgtccatcagcaccacgtcgaagccgccgtcccgcgccagggccagggcctcggcgccgttggcggcgacggtgacgcgatggccggcctgggtgagaaagcccagggccaccttctgattgatgggattatcctcggccaccagcaccgagagagggggaagaaccacctcgccccgagcatccaccgcgcccagggccggcgcccggccagccggcagggcgaggcggaaccagaagcggctgcccacgccggggcggctttccaccccgatctcgccgccctgggcctccaccagccggcggcagatggccaggcccagccccgtgccgccgaagcgccgggtgatggaggaatccgcctgggcgaaggcatggaacagccgcccgatctcggcctcgccaagaccgatcccggtgtcggtcaccgagaattccagccggccagacccatcgccggccagtcccacccggatcagcacatggcctgaatccgtgaatttcaacgcattgcccgccagattcagcaggatctgccgcaggcgtccgccatcgccctccacccattcggggacctccgggccaatggcatgggacagctccaggcccttttcgcgggcgcgggccgagagcagggtctggatgccggccagggtgcgggctggactgaagggcgagcgttcgaattccatgcgcccggcctccaccttggacaggtccagaatgttgtccaggatgcccagcagcagttcggcggaatggtggaccatttccagacgctcgcggtcctctgcctccagcggccggtcgagcagcagccgcaccatgcccagaatgccgttcatgggggtacggatctcgtggctcatcaccgccaggaactcgctcttggcccgcgtgccggcctcggccgcctccttggcgtccagcagggtgatgcgcgcctgacgctcgccctccaccagcagaaactggcggcggcccatgcgctcgaactggatgcgggcggtggcgccgaccagataggccaccccggtcatcagggtgatgatggccatgtcggccgggctttccggcacctcgcgcagttcggcccaggccagcaggctgaccagcggcccgacggcgcatagcagcgccacccgccgcagcggtcccggcgcgaacatgaacatggacatggcgatcagcggaaagaacatgccgccgtggcgatccagcaggggatgggcgaagaccagggcgttgaggaaaaagaaggtgtagaggtgcagatgggtgacggcaatgatcatgcgcgacgtcctggcccgcgccagggcggccagcccgacggccagcacgatggcaatggccaggcgcaccgtcaggaagaacaccaaccggcgtccttcaagcgccagcaggtcgaggggcgcaaaggcaaggctggtcaggctggtggccaggacgcagagataggccccgtcccgcagacgttgccgggacgaatcgacgaaggtgccctcgagttcccgcgaacggaactcgccccaccacgtgatggcggtgtccctgatccccatgggcggcaaggtaagtagcttacctgacccccgtcaatacattgaaaccctgagaagcggagtcggggcggccgcttcggccacccatttgacgtcatcccgaacgggggcgagggatctcatcctggaccggcagatccggttcggcatcgatgctccaggcggagatccctcccttcgttcgggatgacaaatcaatccattacttggtccagcgcgcggctgcctcggccacccgcttgcccagatgggcggcggtcttcttgtcggcttcggtgacgccttccggcccctggtcggcattggcctgggccatgacgccgaggaagctgcccagacggttgagatcctcgacgctgcccttggaattgttgttgccgggcagcaggtccaaacccacccagatcatgccgtgctgggcagcgaacaccgacagttgctgcaggacggccagcttgtcgccgctctggctggccgagacggtgaagcccgccgcgaccttgtcggcccagccccggccgtaccaggtcttggagctccactccatgaactctttgaacttggccgaggccgaacccatgtaggtgggcgagccgaagatgatggcgtcggcgccgttcaggacgtcggccttggcctcggcctgatcggccggaaccagatggacctgggcgcccggaacctgggcggcgccggcggcgaccgcctcggccaccacctgggtatggccgtagccggaatgaaagacgatggcgatggaagtcatgctgctctcctaagatgtaatggtatctgttactgttacgttaattcgcaaaaaaggggcttatccctcgaccttcaaggcccccaccacttccgacagcttggtggtggacagaaccgcgtcgcgggcggcatcggcccgttccatgacccggaccagcaccgactggatgttgcgccccaccggacaggccggattgggcggctggttgtgcagggccggctcctcctcctcgtccaccgcccgatggatatcgagcagggagatgcggtcagcgggccgggccagcaccgatccgccggcgctgccccgcgtcgagctgaccagccccgccttggccagggccgacagcaggcggcgcaccaccacggggttggtgttgaccgagccggcgatccactccgacgtgcaagcctgcccgtccatggtggcgagcagagaggtgatgtggacggcgacggcgaaacgacagttcttggccatgggcaatatgtaacagacatcgttgccattcgcaagccgaaacgccgcccccgctttcccgcgttgctcgctttgcgccgagcggcctattctgtaacgaaagaggggaaaccatgagtgccaacagcaagccgctgaatatcggagaggcgttcggccgcgccatggcggcctgggacgacggcaatgccgccgaggcccggcgtctggcgcgcagcatcgtcgagtccaagccggatttcggcggcgcccattatcttctgggcctgatcgccctggcccagggacaggcccggcgggcggccgagcatctgacccaggcggtggccgccgatcccaaccagtcggttccccgcctggccctgggccgcgccctggaagccctggacaattacaacagtgccatcttgcactatcgcgccatcctgtcgcgtgagcccgatcatgccgaggccaatgcccggctggccgagcttctgggacggctggggcgcaacaaggccgaggcgctggagcatgcgcggcgagcggtcaaggtcgccccccgccatcccgaggccctgtgcacgctgggcaccctgctgcaccagactggtgatcatgccgaggccgcccgcatgctggaacgctccctggagattcgtcccgactgggcggtggcgctgaacaattacgggctggtgctgggctcgctgggccagtacgagcgggcggtggcggtgctgtcgggggcggcggagctgcgccgtgaccatgcgggcacgcgggcgaatctggcggcggcgctgcgcggcatggggcgcctcgacgaggcccggctgcatgccgagcgcgccaccaagatcaattcccgcgatatggcgggctggctggaactgggcttggtccgcaaggcgctgggcatgcccgaagccgccgccgccgccttcgagcgggcggtgaccgccgccccggattcggtgcacgctcattactgtctcgccgaggcccggctggtgctgggcgagaagaaccgcgccgccaagtccttccgccgttgcctggaactggaccccgaggaccgccacggcgccgccctcgggctggcccaggccggcgccggcgaagcccccgcccgcgcgccggacgcctatgtgcgccagctgttcgacgattacgccgataagttcgacgccgccctggtggacaagctggcctaccgcgctccggcgctgctggcccaggccatggacaaggccctggaccgccgccaggacctggacgtgctcgacgcgggttgcggcaccggcctggccgccccggtcctgcgccccctggccgcccgcctggacggcatcgacctgtccggcgccatggtggacaaggcccgggcccgcggcctctatgacgggctggaggtgggcgaactggtcgccggcttgaggcaccaccctcacgcctatgatctggtggtcgccgccgacgtcctggtctatttcggcggccttgaggacatcatggccgccaccgccctggccctgaagcccggcggcgtgttcgccttcacggtggagcgtgccgacgactgcgcctcctatgtactgggcgccaagaaccgctatgcccacgcccccgaatatgtggacgcggtggccgccgccaacggcttttccgtggtttcggccgagcgcgcctccacccgccaggaagcgggggaggatgttcccggtcttgtggtggtgctgcgcaagggctaaggtccctgcgatttcatagcggaacgttccagcgatcatgtgcggcttcgccggctttctcgacctgacccgggccacgcccgaccgtgaaacggtggtgcgcgccatggccgccacccttgtccatcgcggccccgacgacgacggcgcctgggtggacgacgatgccggcgtcgccctgggctttcgccgcctggccatcatcgacctgacgccccagggccaccagcccatgacgtcccatgacgggcgctgggtgatcagcttcaacggcgagatctacaatcacgccgacctgcgggctcggctgggcgaaagcatggcctggcgcggccattccgacaccgaggtgctgctggaggcggtctccgcctgggggatcgaggcggccctggccgccttcgacggcatgttcgccttcgccctgtgggaccgccgggagcgggtcctgaccctggcccgcgaccgcttcggcgagaaacccctgtactgggccaaggccggcggaagcctgctgttcggttcggagctgaaggcgctgcgcgcccatcccgcctggaccggcggcatcgaccgcgacgccctggccctttacatgcggctgggctggattcccgccccccacaccatccatcccggcgtgttcaagctggaacccggccacctgatgcgggtgaacggcggcgacatctccgccaaggcctattggtcggcggcggactgcgccgccgggctggaggacagcttcgccggcagcgccgaggacgccgccgaccggctggaggaactgctgcgggagtccgtgcggctgcgcatgcaggccgacgtgccggtgggcgtcttcctgtcgggcggcatcgattcctcggcgaccgccgccctgatgaggcaattatcggccgagccggttcattccttcaccatcggcttcgatcaggccgggctggacgaaagcgcccatgcccgcgccgtcgccgaccatctgggcaccctccacaccgaggtgaggatcagcgatgccgaggccctggcccaagtggcgcgcctgcccgtcctctacgacgagcccttcgccgatgccgccgccctgcccaccgccctgctggcccaggtgacccgcaaaagcgtcacggtggcgctgtcgggcgatggcgccgacgagttgttcggcggctacggcatctaccgttccattcccagggactggcggcggctgcagggattgcccgacggcctccgggcgctgggggccatgggcgcccgcgggctggccggaccggccgaggggctggccgccctggcgggaacggtccgcaagcgccgcagccatcccggccaccgcctgggccgcgaggccgagaggctggaggccggctccctggccgagctgctgggcctgcattattcccgctggcgcggcatgtccgatctggtgccgggggccgggcgggccgagagcctgttttccgcccccacgccccgcctgcacgatgacgccctggccaccatggtgctggatgccatgggctacctacccgacgatctgtgcgtcaagaccgaccgcgccaccatgggcgcctcgctggaggcccgcctgcccttcctggccctggacatcgcccgcttcgcctggagcctgcccacgagcctgaagatcgaaggggagacgggcaaggcggtgttgcgccgggtgctgtaccgcctggtgccgcgcgccctggtcgaccgccccaagatgggcttcgaggtgccgctgcgccgctggctgaacggtccgttgcgcgactgggccgacgacctgctgtccgaggagaggctgcgccgccagggtcacctgaacgccgccctggtcgcccagtgctggcgcgagcaccgctcgggggccaagaactggcagaacgagatgtggcacgccctgatgttccaggcctggctggaacactgatccggatcaggaggcgtattcggccggatcggccagaccggcctcggcgaagcccttgagccgcaggcggcaggaatcgcaatggccgcaagccttgccgtccggagtggggtcgtagcaggtcgacgtgatggaataatccacgcccaggtccagcccgcgccggatgatctgtcccttggtcaggtcgatcagcggggtgtggatggtcagccgcgtcccctccaccgccgccttggtggccagattggccatggcctcgaaggccttgatatagtcggggcggcaatcgggatagccggaataatccacggcgttgacgccgacgaagatgtcggcggcgcccagaacctcggcgaaggccagggcgaaggacagcatgatggtgttgcgggccggcacataggtgacggggatgccggcggggatggcctcgtccagctcacccttgggcacggcgatatccgaggtcagcgccgagccgccgaagacccgcaggtcgatgtcggcgatgcggtgatcgcggatgcccagagccgccgccacccgctcggccgcccggatctccaccgcgtggcgctggccgtagcggaaggtcagcgccgccggggcaaagccctcggccttggcgatggccagcaccgtggcggaatcaaggccgccgctgagcaggacgatggcgggcttcatgactacagcgagaaatgcgacgcgatgaaggaatcgatctcggcctcggaccagcccttggcggccagatcggaccgcagcttggtgatatccacgttgggccaggtgtggcagctctcgatggtgtgcttgtcggcgtcgacgatgcggaagtcgtagggccgcttctcgctctggaacacgtcgtagtacagcacctgatccacgtgattgtcgggcaggaaggtcaggatgcgtggcttgatgtcgtacagcttctccggcccggaaatgtcggccgaggcggcaatgatcagctcgtcgcccttctggcaggtgcgggcggcggcgccgttcaggacgcagcagcgcgagcccggctcgccgaagatgacataggtcgaaatgcgggccgccgagttcttgttccagatgtcgacgaattccatgggatagatgccggccatctcgcactgctcgggatcgagggtgatcgagccgtgataattgaggtcggcattggtaacgcgaatgccatgcagcttcgcgcgaatgatcttcatcatgggacaccggaacaaacttgcagcattgggcagtgacgtaaacgcactggggcctgttccgcaacaccttattcgcgtcaaggggtgtggaccgcgaggggtggggggctgattcggcgcttgacgccctcatgcgcgctgtcgtttgctggagcttccgcacttgctcagtaggatcatcccgcccatgtccgcacccgccaagcccagcggcgaacccatcgccggcaagcaccagctggtcgagtacctggaatccgggtgcaagccgaaggatgcctggcgcatcggcaccgagcacgagaagttcggcttctcgctcgacgacctgaagccggtgccctatggcggcgacaagggcatcaaggccatgctcgacgggctggtgggcctgggctgggagccggtgttcgagggcgacaacgtcatcgccctgcacgattactgcggcgccgccatcagcctggagccgggcgggcagttggaactgtcgggcggccttctggacaacatccaccagaccgccgccgaggtcacccatcacctggcccaggtcaagcacgtggcccagcatctgggcatcggcttcctgggggtcggcttccagcccaagtggagcaaggatgacacgccctggatgcccaagggccgctacgtgatcatgcggcgctacatgcccgaggtgggcaccaagggcctggacatgatgctgcgcacctgcacggtgcaggtgaacctggacttcgcctcggaagccgacatggtgaagaagctgcgcgtctcgctggcgctgcagcccatcgccaccgccctattcgccgcctcgcccttcgtggacggcaagccttcgggcttcatctcggcgcggggcgacgtgtggaccgacactgaccgctaccgcaccggcggcctgcccttcgccttcgacgagggcatggggttcgagcgctatgtggactggatgctggacgtccccatgtacttcgtctatcgcgacggcaagtacatcgacgcggcgggccagagcttccgggacttcatggcgggcaagctgcccgcctttcccggccagctgcccaccatgggcgactgggccgaccacctgaccaccgcctttcccgatgtgcggctcaagaagttcctggagatgcgcggtgccgatgccggcccctggcggcgcctctgtgccctgcccgccctatggaccggcctgctttacgacgataccgccctcgacggcgcctgggagctggtcaaggactggaccgccgagcagcgcgaggccctgcgcgccaccgtccccgcccggggactggccgccactatccatggccgcagcgtgcgcgaggtggccgccgacatgctgagcctggcctcggccggattgaaggcccgcggccgcctcaacgattcgggccgcgacgagaccatctacctcgaccccatcgaatccgtggtcaagaccggcaagaccgcatcggaagagatgctggacgccttccacacccgttggcggggctcgatcgatcctatcttcagggaatacgcctactagagcattttccgctcaatcgcggtcacaaccggcagcggcgaagtagttcaggcattcggccggtgtgaagagatcgatacccctggcgatggcagtccagaggtcgtccttggtcctggccgcgaccttcttgaggaagctcttgaacttcgagaagaccatctcgatggggttgaagtcagggctgtatggcggcaagaagtacaactttgcccccgttgcctcgatggcagcacgcacggcggtgagtttgtgggcgggcaggttatccatgaccacgacgtcgtcctgcgacagcgtcggcgccaggacctgctcgacataggccagaaaggcgggaccattcatggcgccatccaggaccatgggcgccgtcatgccactcagcctgagggcgccgacgaaggtcgttgtcttccaatgtccgtgcggcaccggcgcccggcaccgctcgccacgtagcgcccggccccgcagccgggccatcttggtcgaggcgccagtctcatcgatgaagaccaggcgctcaggggcgagatcgggctgaatctcgaaccacgcctgccgtcgccgcagaacatcaggccgctgcggctcgcttgcgtgcgccgttttttttgaacgtcatgtcgtggcggtccagcaggcgccatacggagctgtgggcgacccgcagcccgtgcgtcacctccaggtgggccacgatctccatcagggtgatgtccggcgtcttgtcgatcaggcccaggatttcctcgacatgggcttccatccggtgcgagtgccggtcaccgccaataggcttggggtcggcaagcccctcctggcgccagcggctcatccatttgatcgccgtcgaggcagccaccccaaagcgctttgccgctaaacggcaggattgcccattctccacggcggctatcaggcgttggcgcagaagcgccacaagatcgggcgctccgacgtgctgtcatatgatgcagcccggcaggaggccatgcccatcaccgatagcggcgaagtctggtggagtgacgtcgcgccatcgcaacgcgccctgtatggcagttacgtcgttctgggcgaggcgttcttccgcgccattacctccaatcccgtgccggtggatcggcgcgccttgaaggcgcttcggcgcagcccccttgcactcgatctctacgcatgggcaacccatcgggtctatgaactcggcagcgagggcgctttcattccctggtcgggccttcgtcgccagatcggtgcggcctattccgatcccaagaatttccagaaagcagcgaaacaggcactccggaaagtggcttcggtctatctcggctttcgctactcctgcgaacttggaggcatccgcattctgctcggcagcacaacagcggtgccgtcgaataagtcggggaaaagttcgcatatccacggtgaaacggtaccccggcccacagcagccccaccaaaggccaggggagttacccccagatcgagacggtgaaacggtacccgtgaaggacggtgaagtggtactccgccctatatacacccctatagaatctcttcctgttgttggcgcccggctttgtggacaagccgggttgctcggcaggacgcggatgcaggcatcgggaggacgggccttccgcgcgccccaggcatcccgatgcggcaccgatggggggtgtgcagcgccccggcaaagtgccggacggaacctccgtctggccgcccttcgggcaggaacaagcccgctctctctgcgagccgaaatacctcgggggtttgggggctggcccccatctgccggaagcggatttcgacgcccccggtttggacgcgacagaatcggccttgggcgtggccttttctcccgtggacgcgccgtcacccccccttggacgcgctcgggcgcggcatgcgcgcaggctccctccaatctccaaggcttctgcggctctcgccacagccatacacaaggcaggatacgcactttgtcgcacacctggggcacaaacccgggcttgcgacaaagcgcagggcttggagcgcccgcctccggcggcttgaaggaggcaggacatgacacgtttcacaagggccagtcggatcaatgtccgagttgagaccggcctccgccaagcggttgaggccgtagcagccgacatgaagtgttcgccatccgtggccgcccgccacctcttggccgaggccctcgcttatcgccgcgccgaggccatggatgaaaagccgggatcggcggcaaaggcgctgggccgcattgccgcgtgcgagatacgacggcgaaacgactacaccatctggggaatgtccgaggacgtacggcgcattctcgaatccatggggattcgaaagccgaaggtgtgacctcacccctgtcatccgtcttcaaagacattccagccgtgctgctgaaatggatgcgctgttctcaggaggcgccccagacaccccgccggttctcccgcgccaacgcttcggcattgcggatgaaatctggggcgttggcggcggccttggcgaaaccggaaagggcgaagacctcggcgatatcgaggcctttggcgagcgagatgcagcgccagccgccgaccggcgccatatagcacttcacatttcccgcctgagccaaatacgtacgggcaaaggctttggcttccggcaaatcgacggggcgcaggcctgtcaggggtagacgctgaccattcacgctgagggtggcggtatccagaatgtccggcacgcccgtgatggtttgcggcgtctttggcggagccgaagctggcggctttacggcggcggctggctgcgttgcgggtgggcttgccggaataagccgagggacaagaacagccgccaaagcgacaaccaaactggtggcgatggtcagcccggcgatcttcacgatggcggggcgcttattgggcggcggctggaatgatgtgggcgccgtttcttcctccggctccacaagggccggctccaccacaacatgctgacgcccatacaactcgatgatggaggtaaccccggcggattcgagcggcttatagccctcgcccgaagccatggccttttccatcatctcggcaatacgagtgccgatcaccgccatgtcgttctcgaacaggaaatgctcggtcttcggttccagaacagcctcggcgttggacgggcgcggggtgtgaggcaggatcaccagcggcgttatggcaaaaaagccgccaaccgatgaatgggccttccagtcggagacaaaggacatccccgccccaaccgcttggtgatagggattcttgatggaggcaggctggccggcggaacgggtggtgcttgtccacttgcgccggctgtccatgggattgccgagcgtaacggccccgcccttgacctcgattaccaccactccgaagcgagggtggaggaccagaaagtcgatctcacggggctggctgcccagagtgccaatggaccacaggacagtaaagtcgccgctcaattgccgttccagcgcgtggaagacggcgcgctcggccccggcctcccgccctacttcggaaaacgacgcaggaatcatcttcgccatcggacgcactccgccgctttgcttacgaagcgccccagacgccccgccggttttcccgcgccataccctcggcgttgcggatgaagtcgggtgcattggcggcggccttggcgaagccggacagggcgaagacctcggcgatatccagtcccttggactgcgacacacagcgccagccgccgaccggggcctgttcgcacgtcacccctcccgcctgttccaggtaggagcgggcggcggcggcggcttggggcatttccaccgggcgcaggcccgccaggggcaggcgctgtccgttcacgctgagagtggctgtatcgagaatctcggggatgccggaatggctggcgggaatttgcttggccggcgcgatcacggcggcgggaacgaccggggccagcttctgaatctggggctgtaaagttgtggcgggaatggtcgccgagggggaggacgagttgaacagtttcggccccaggaacgccacagccaggaccagaggaatgccgacggcaaggccaatcttcaacccgctgctcagttgcgggccatggctgaccggggcggggcgatcatccgagcggacattcaggatcgtgtcggagccgctgggcgcggcgggctggcccaaggtgggctcggatcgcgccggccggcaggcgaggccgtcgagttcacgcaaagccgcccggtgctgcaattcctgcgcggcggccaccgaaacacaccgcttgccaacgggattgaagaccgtgcccgtggccttggccaccacgatggccagcggtatgccgatgatggtgcagcacaggaggaacgcctgaaccaccatagcggcggccaggagcagcccgaaggggaaccacaggatcatgatgatccaggaataggccttccacagcccgatctcggcgccgggctccaggtcgctgtcgcgcaccatggcccgcccgaacggccccagatagaacttgcccaactccatcaggccgagccccagaggggcgcccaccacagtaaccgtgaacagcaggccgatcagataggtgatggcggcattgatgaacccgaggaacgggaagtgccacagaatgttgccgagcgtcctcatttccgcctcctcgcgggctaggtcctagacgggaagcctcagcgcgaggccaccacccactgcttctgttcgttcaggcacgaggtcacggtttcctcgtgctgcttgcccgagctatcgaccaccacctgcttcagctggcggcaggtgcggccatcggccagggtggtgggggcggaaaccggttcgacccagccccaattacccgactggccgccggagcggatcggctcgaccgcgccccactggcctgcggaagcctgcttgccgggttcgacggcggcccattgtccatttccctgcgatggcggggtggacggggcggggggcggcaggggggccgtcttgacctggcgctgaggggcagccttcggcttgggcggctgggatgcggcagcggtcgtcgaggccgtctggggtgtggcggccggagctgacgccgttgccggcgtgctggccgtcgcgggaacctgggcggtatccgacgcccacaccaccttctgccccaccggcgcctcgcctgccgtctgcgaggcggtagccagcgcctgcttgtcctggcaatccagcagcgagccgatctgctggccgatcagaccacccaccgccgcgccgaggagggctgtgccgatcttgccgctggctttgcccagcagcaggccggcggcaacgccgccaatcactgcgccgatagctgcgccacccaccttgcaatcgttgtcgaaggcagtctccatggtcttgcaaccggtcaagaccaccgggacgcaaatcgccgaagccaggagggacatccgtcccagcctggacacaccaaagctcatcatgatttcccccaagcaaaaagcatcttgcggcaactatcccttgccaaacagggggcgtcaagccagccaggatgatcactctcgacacccattcggctaaccctcgcgatagatgttccgcatttgttcttgcctgactatcggcccttgggcatcatacccctggaaagtccgccggttcggctctctgagatgacgagcgagccctgtgcgccaggcttccacggaccaatccccccgttctgccgcatgcgcagcccttggcgcgcgtcgtcggccttgcttcaaggattcccccaatgtccatcgatctgaatgacaccatcggtagctcctaccccgcagatcccggggacgtcttgaacgtcaagacttccatgaacaatcttggctattacgatccacccgccgcctatgggctgaccccttggcccgacacccccatgttcgacggcatcaagaacttccagaaggaccatgaccttgaggtggatggcatcatgcatcccgatggtcccaccgtcaccaccatgaacaaggggctggcccaaggcgaagattcgccctccgacggcaacgaacaattggcctataatccggcagcagccaatctgctcgatatgatgttgcagcgcgggacgaaggggggcggcggcggcaattcctgccctggtgatcgagccccgaggtccggggatgaatgcgatgagctatacaatgcggacagcagcatttgccgctccctgccgccggtcccccggattcggaggaactgctggtcatcggcatcagagcgcaacgcggcctgccgctccggccggccgctgccgcccctggacagcagcgacaggccttgacgattggaggctccaatccgatggatgaattcgccgttaaggtaacggccaagggagccgatggctcccttgcaccgtttcatatctacgtgggcacgcccgaggccgtcgatgacatcgtctcggggtgcctgacttggtgcagcctgctcgagaagcctcatttggtgaagggtgagacattggctcaggcctacagcctcgcctaccgctttattgcccagatggtggagtatgccggcctgaccctatttgaccgggacggcgccccctttcaactgccccgcccgccggatgggttcgaggacgagatatgaggacgtccagccttgccgcccccttcctcaagcgcgtcaccctgttgcccgaaaaggcggaggaaggctgctttcccttcggccatcttcctttcctgaaaggcggggatttcacgctggacctgcgggccgccataaccatcctggtgggcgagaacggcagcggcaagtccaccctgatcgaaggcattgccgcctgcgccggctttcccgccttgggtggcagtcaggaccaccggccaggagacgagccgggcgctggcgccctcgggcgggccttgcgcctgtcctggctgcccaaggtgtccaacggcttcttctttcgcgccgaaagcttctttggtctcgccggctatctggaccaggaaggctctctcgaccgtcaaggtggccgcctgctgcaccggcaaagtcatggcgaggccttcatggccatgttccgtcatcgcctcgacaccgaaggccgcgccatctacctgctggacgagccggaagtggcgctgtcgcccacccgccaattggcctttctccgcatcttgcgcgattggcaagtctcggggcaggtccaggcgatcatcgccacccactcgccgatgctgatggccttgcctggggcagatctgctgtccctggacggcggagccatccatccgatgcgcctggaggagaccgagcattaccgggtgacgcgccggttcctgagtgatccggacaccgctttgcgggaattgtttgatgaggactgaagccgccatcaacgatcctgcggagcgaacttcccgacgacacttccaagtcggaagaggcctttctggccgaggtcgcctcggtggcggaaaccgtcggccaatcgggtgatccgggggcatcgcggaagatcatttccgcatccaaggtgcactccatcgtcaacgtcacgggaacgaccatggcccatgacggcgacggcgccgaactctagtcgtccatgtggtatcacatcggcgcgcaacggccatactgcgtcatggtgcatctgaagctcatcgccccatcccggcgccgtggtgacaatgactatgcggctttggttcgcacccttgaccacagcctgatgaatgcggccatcgactggatgcgcctttgtccctccggcccgtgacctcctcgcggcgcaggtgacggacggcccggctgcgcgctatagtcggtgggcaaaacaccgacgaggctgccatgcgcacccttgacgacatcatgacccagcttcgcaccttgcagcccgagttgcgccgccgctacctcatccgctccatgggggtgttcggctcgtatgtgcacggcgagcagcgcgaagactgagctactccccggaaattggacactgacggaagctacgatctgatgtttgctgatccccaactacgaggagatcagagatgtcgaagcgcaggaaccatgacgcggccttcaaggcgcgtgtcgcccttgaggcgctgaagggcgagcggacggtatcggaattggcgtcggcctatggcgtccatccgaccatgatccatcaatggaagaagtccctgctggacggggcggcggagatcttcgaacgcggggccaagaagaaggccgaggtggacgaggatacggtgcgatccctgcacgccaagatcggggagctggccgtggccaacgattttttgtctcgaaagctcaagccgtggaccggcaagtgaggcggaccatgatcgagcccaaacacccggcgctgtcgatcggcgcccagtgccacctgctgtccattgcgcgatcatcgttctattacgagcccttgggcgagacggaggcaaacctggagctgatgcggttgatcgaccgccaattcctggaaacgccgttctatggtgtccgtcagatggcttggcatctccagaacgagggccacccggtcaacgtcaagcgcgtccggcggctgatgcggctcatgggcctgatgccgatctaccagaagcccaacaccagcaagcccgccaagggccacaagacctatccctacctgctgcggggcctgcggatcgaccggcccaatcaggtctggtgcgccgacatcacctatctgcccatgcgccggggattcctttatctgatcgccatcatggactgggccacccggaaagtgctggcctggcgcatctccaacacgctcgaggccgacttctgcgtcgaggtgctcaacgaggccatcctgcgcttcggcccgccggagatcatgaacaccgaccagggcagccagtttacatccttcgcctggatcgaccggctgaagcgggccggaacccgcatctccatggacggcaagggccgttgcatcgacaacgtctttatcgagcgcctgtggcggtccctaaaatacgaatgcgtctatctccatgcctgggaaaccggctcgcaagcaagggccgggatcggaccctggatcaccttctacaaccacaaacggccccacgccgcccatggcggaaggacccccgccgtggtctactggaacaccatcaaccaaaccgatcagcaggcccggagagtagcttaaacttccccgaattctgtccaaccaatggggagtagctcattcttgtccccctcgccaaccacccgaaacccgccaagctctttcgggaggactttgaccgtctcgaagacggcggccttggtcttgcttggacgctcaactccaatggccagggcaatcactacgttcgagcttccgttccgggcgtcagtggcaccctggagacagtctcccgattggtcgtaggggccgggcgggggcaatgcgtccagtaccacgatggcgaccgtctgaacctcagggcggacaatcttttcgccagcgaaggctatgcgaagaggagggccgaacttccagcagccgacctctactgacctacccaacgcgacaatcgcagcccgccagtgtgcgggctttttcattttctggagaagcatatggacgttcagcccacatacctgaaccgagagcaagccgccgccttcctgcacgttcagcccaagacccttgccaactgggcaagccaaggtaaaggccccaagttccgcaagccgggtggcagagtggttttgtatccccgcatggagcttgaagcctgggtgaacagcggcgaggcgtgattattctgggccacggggggcgctggggaaataccccggtgcttcccggctactcccaaaaaatcccggcaagaaacgtactataggcgtattcattgcccgaatacgcagatcaaccagcccttcgaccggcgctaactcattgattattctggagattttttggagcgggtgaagggaatcgaaccctcgtcgtaagcttgggaacttctggacattggctcccgcaggctcctgctcgatccacaatctgttgtttttcaacggttttcaaaaagccaaattcccgctcactcccctaaaatcccctcatttcccgagcgttgacttacaagagccttacaaattatcctgccttcaacgtcgtaagcttttttggcttctgtcgaggaaggcgaggaaaatcatgaagttgaagctaagtgctgcgaagcttaagaccctcaccgttcccgagggaaagtctggggaatacgtctgggacacctcccttcctgggttcggggtgtatgtgggcaagacggccaagacgttcctcgttcagttcaccaccagagccggtgaggagaagcgccacaagatcgggcgctctgatgtgctgtcgtatgacgccgcccggcaggaggcgcttcgcgttctgggggaggtgcagaagggcgcagaccccaccgccgccatcaagcaggcccggcaagaaggccccctgtccgaggaattggtgaattggtttgacagccacaccatgaaggacagcacccgaaagacgtggcgttcggtcgtcaacaaccaccttatccccgccctcggctcccgcaagccctcgaccatcaccaaggcggatatcctggccgcgtatcgggacatccaggccaagagcggacggcaggccaatcaagccatcatcatcctctcgacgttctacaaccggaccacggatggcaagttcaaccccgcctcggacttccgcaatgacaagtcgatcaggaagcacagggacgcggagcgggaggttgtcctatctcaggatcaagtccgggcactcctggccgacttcgacaaatcccccgcccagcagagcgccgacgccgcccgcctcctgttctacacaggtgcccgcatcggggagatactggccctccggtgggatgccgtgaaccttacccaaggcaccatcaccttggcccacaccatgaccaaggaagccaaggccaagacccttcacctcagcccccgcgcccaggccatccttgagcgacgacaggaagaggctctggaaggggccgagtatgtctttcccggcagggatggtgaggcccatcaggtggtgatcaaggctttctggaaggcagcctgtaagcggtgtgggattgagggggttcacatccacgacattcgggccacctactccaccattctcattgccagcggcgagagtgccaaggctgtggggaagacgatgggtcatgccgacaccaagaccaccatgcggtatgagcgcattgcccaggacagggccaaggacattgccagcaaagtggatgatctgttttagctttctgggtcaggggtatggagctttggttatcctggcacctgattggggataatgatcttgggcaactggttgccaatcccatgaaccgccatggttacggtattttgcttggtgtcccatatgtccaggttatagctcacgtcggcagccttgaaagcactgacaagaagccgcacagtctcccttgctcgttcctcgctctctgctccactgcgaccactaatggtaatttcatattgcatggtatgcctccatttttgactgtactcctcttgggcttggaagtccgtcatcatcttcaatgggcgcgataaggaggtaggtggcacccgaatgttcggaacaaaaatgtgagcgggtatcaggcaattggaaaatggcgactacccccatagggggcctcggtccccatcagcacgacggcaggggccacctcgcaagaactgaaggcccaccatcagcacccacagcatggcgcatggtgccccgctcaaggccattgacagccgccaccaaccgccattacaaatctctcaacgaacggagagaggagtgtaaggccatgcggttcgtcgcctattaccgggtcagcaccgacaagcaggggcagtctggcttgggcctggaagcccagcaagaggccgtccgctccttcctggctggcaaaggctggcctccggtggctgagttcgtcgaggtggagagcggcaggaagtccgaccgtgcccagcttgccgccgccctggctgcctgccgtctgcacaaggccaccctggtcattgccaagctggaccggctggcccgtaacgccgccttcctgctgaacctccgtgacgctggggtggatttcgtagcctgtgacatgcccgacgccaaccgcctgaccgtgggcatcatggccctggtggcagaggatgaagccgaccggatcagcgccaggacgaaggcagcccttgccgttgccaaggccaagggcgtcaagatgggtggcttccgtggctatgtccccagcgagaaagaccgggccaaggctgctcaggccaagcgggagaaggccaagcggctggacctgatgccggtggtggaggccatcaaggcagggggcaccaccagcctgggaggcatcgccagggcgctcaatgagcggggcatcccgaccgccaggggtgggcaatggcaggccgtccaggtcgggcgcttgctggcacaggcgggggactgagcgaggaatatttggggctgtgagggattgtgtggggcacatcagcccccctttccgtgccacctcagccccctttcaggctcccctgatctagtcacctgtaactatatgtcattggttttgctggtattttcctcattgaccgccctgccatccgtcatcattgtccaggccgtcaacaccacatcaggggaaccttcgccatgctgatcaacacctgcctgttcgagcttgagattgcctatggtcacctcttcatccgtgttgcccgcctgggtgaggtgctgttggtcatcagcaagcagcacccgaccgaacagcgcctgaccttctgccctgcctgatcgggaaggccaaaccggaggatttccacggtttgacggctccaattgtgggttagacccaccttttcccaagcccctgccggttcctcggtgggggctttgtcgttcctgaccatcaacgcccaccttcacaccttcgacatgaccagggacggcttcatgctgctggatgccgacgagcataaggctcacaaactgagcgaaaatcgtgggcgtcccaacatcatcgtctccgagggtgtcatgaatgggcatcatgaccacgcatccccggagaacgtcgtcctccctgccatccgcaaggatggtgcgtttcacgcatggcggctatgcgttccacgaataggttgccccattgaatgagcgggggttgcttagagtgtacggaggtggtgattgggtgaccagtgaagtggtccttggagttcatccccatcatcaccatcaccatcagtaacaacctaagtccccttcaaggctcaccacgaggttcactctgcggtgatcattgggtgtcttggggaggttggtggtcttctgtggccccctccaattgtttcacggatgtgtttcacgattaggttgccccattgaacagccccaactccatgccccctgatctcggtcagcatggttgatggtggtggtgttccccgctttggagggcgggtaagcgatcatggttcctagctgccggtagcggcttctcggatcaacggatgtgggcagggtgcaagtcaccttgccccatttgttttcataatccaccccctccatcattcccaacattgcgagatgccccatgagccaaccgaagctgtacaagccccggtcttccaagacccatgaactgaagctgttcctgacccctgcccagcatcagcgcctgacctatgtcacctccacctattccgatctgatggaccgcaaggtatcccagtcggtcaccttctgccgtgccctcgatctgctggccggtcaccttcaggcccagcttgaggcccaccctggggaagtcatccgggaagccgagaaggacgccttgatgcgttccatgtggtgatggtgtcgccatgaccaacgccagccaccgagcttcccaggcccagctatgggcactctggcaggccgtcgccaagaccctgctggatcaactgaacactgcccagccgggggaggtgaaggcgtccctgatcaacgtcgccagagccttccttgccgacaatgggattgtggttggtggtgcccatgatccccggcagacccgtgatggtctgtcccagcttctggataacgtccctgactttgatgagggatggtctgtcctgaaccaacactgaccaccctcaatcagattgatgggggtatgaggaaatcttcgcacaccccccacccctgaaatctcaggcatgggtctgctcaaatcttagcacacccccatccctcaaatctgagggcaggggctgtccaaatctggacacaccccttcaccaccacccaagcccaccgagaggcccgccatgcgagcttgtgaagtcccgcattgccgggaccatgcccggtccttcagtcgctattgcaggcgacatgaccagaggaccaccaacaccggccaccccgaaggcaccaacgtcctgcggggggaatacaagaccctcttcctgttggcccatcagttcatcacccaccacaaggaacaccctggcatcagggctggtctggaatggctggggggaatgatggctgatggtcgagaccctggcaccatccatgcccgcagcagtgcggctgatcggcttggccgatggcttcaccagatgcagactgagggtgtcactgccgaggatatgcttgccaccatcggggccatctatgccctgcgagagtggaaccccaggcggttcctgtctgatcggcacttcgaccatcagcttgccatccgtgtccttcgcctgaccccggccccgttctcggaacgatggtccgaaggcaaacccaagaaggtctatgaccggatcaccggccccacccgtgaccttctgtccacccgcatcaatgccgcccttggccccctgatcctccgcatgggtcgggaagtggcgagtgcggcccaacctcgcccccaggaacgtcttgagggcatcgacttcccattcaatccaaaaggcacctatccatgaccgattattccgccctctccattccgaatggcaacacctccgccaacgtctcccccgaccgtgttcaggtgaaccgtcaaggcggggtctccatgaccctgaccaatggcgtggtcaccaccaccagcagcatggcaacgcgggaaatccaggccccccgcaacagcgtccagaacagcggcaccatcaccgaggcccgcaactcctggggcaccgtcaagaccggctccgacatcaccgaggccagcatcgtcaacatcggtggcatcgagaccaccatcaaggcggctatggctgccggtatggtgacccgcaatgccgatggctcctatgccgtggctggtggtcagcaggccccgcaggatcagccccaggccgacccgaacgacggcatggaaagcctgggtgacgatgccgttgaggccagcatcaccgagattgccaccaaggcttccgcctccgatgtggtcggggtcatcaacgccctgtccaagggtgagggcatcccggaaactgccgtgggccgtatcgcttcccagatgggccttgagcctggggaggccatgcaccgcgccgagaccatccgggcggcgttcgagacccaggccctgaacaccatcagcaagtcgggcttcgaggcgcaggacgtggttgcctgggcttgggagaaccgccccgacctgatgaagcaggccatctacaagcaggccaccgagcggaccaccaagggttatgacggggtggtgaaggcgtatctggggggcctggagaagtccagcccgcagaccatcctcaatgccaagctgcccagcggcatgaccgcccaccagcagcaggacggcaccatcatggttaccaccccgcagggcaacttcagttggtcttcgttgctccgcatgggtgccatctcggtggggagggggtgaacatggcagccatcgtcaccaccacccaggacaccggccttcccgatctgatcgaagacggtggagaagtccgggtgctggataccatccttgccgagcggttggggtatgaccgtccccgagacatccgcaagctggtcaagcgtcaccgggaggcgctaggggggatggggagtttgctccaccgtggcgcaaaccccggccccaagggagggcggcgggcaaccgccttctacctgaccgaggtacagaccctgttcatcctggcgaagtccgagaccgcacgggccaatgtcgagttggcctatgtcacccaggtcttcaccgagttccgcaggggcaacctcgttgccagggatgccgacacccaggcccgccttgacgcctatcaggccgaccggcaggcccgtcttgcccgtcatttggaggagaaggaggcccgtgaagacgccctccgtttcctcaatcgtggctgtcggaggtagtcccgtggcctggaacaagaacccccgcatgaacaagaccgagcttgccgcatggcggctcagtaacccggactacctgttcccccgtgttctgcattgcacctgggaacccccggcagactgggggccgctcgtctaccgctaccccctgcccagtgacaccggacggccacccaggcgggaactgctgttgtacgaaatccccccaggcgtgaccccgcgccgtgatttctccatgcctttccccagcaaggtcttggtcctcaaggccattgcccgccgcttcaaccatgatcccgacatcttcgaggaagaacccgatgaacaaccctgaaagcctgctcgtccgcattgacggagcttccaccttcctgacccgcaacaccgatggcagcgccagcttcatcgacaatgctggtcaggtggtcgccatcccctccaccccggaactgaccaagctgctcgataccctgcccaggggttccggcatcgtccgtaccgaccacatcgaccgctgaggcccaccatgagcaaccctgaaaccgttatcgcaggcaagaccgtcctgcaccgttccgcctttggcaccgtctccttcaccgacaccacgggcaaccgggtgacgatggacagccccaccgcgaacaagctgttcgaggccatccgtgacggctccggtgagaaggtcgaggccgtccaccgcgaggggacggagaagcccaccaacctcttcgtgggtggcaagcgcaacgtctatgccgaagacagccgcacggctgccaactggtgacactgaggtggcccctgccgggaaactggcgggggtcatctgtccatctatccccgcaacacgcagtcatcaccagcccgccagtgagcgggctttctgcattctggagacccatgccgatggaagttcagcccacatacctgaaccgagaacaagccgccgctttccttcacgtccagcccaagaccctcgccaactgggcaagccagggcaaaggccccaagttccgcaagcccggtggcaaggtcgtcctgtacccccgcatggaactggaagcatgggtgaacagcggggaggcgtgaccatttcgggccatgcgaagcaccggggaatatgccctggtgcttcccggcccatcccccttgatcctctttactgacttacaagggccttacaaattccaaaatgaacaaagcgcccgacctttcggcggacgctaactcgttgaattcactggagtttttgtggagcgggtgaagggaatcgaaccctcgtcgtaagcttgggaagcttctgctctaccattgagctacacccgcgccgaggcgcagaagatagggggctgaggggctgtgtgcaagcctgccgatgcttccctccggcagaaagtgccagatgctttggcctcaggcaacccctctcggtgtcgaggcgggactccgtcagaccgctaggtggaaattggtctggtccagggcgctggtgttgacgttgttcagcgtgcccaccagggtggaattggtattgtcggccgcccccatgttggtggtgtgccacagctccacattggcaccgttctgaatggcgacgatgccggcattggcatcgccgaaatcctgggcggtgctggagatggaggtggttccctcggcataggtggcgccgacggtgccggcggtcagggttccactgctgcccaggccaaagctgccgttcgacagcgtgatattatcggcggccgagttgaaatcggtgatgacggccgtgccggtggaatcgaggacaaagctgtccgacccgcctccgccggtcagcgtattcgtcccggttccgcccgccaggatgtcgttccccaggccgccgaccagggtgtcatttcctgcggtgccagtgatattgaagttgagatcggcggcagtgatggtgccggcgctgccgatcacatagccgccatcggtgccgatgccggaatccgtgctgccctggtagatgtacaaagcctggtcgaaggtggaatagaagccgtcgccctccacgccaccggtgcgggccaccccgccggtcagtgatgactgcccggcattgtagctgccgacgacctcgaagcccgacacatccacatgggtcccgctcagggagatgtcgatatggtctgtcccggtggtgaagtcggtgatgacgtcacggaccgaggcactgtcctgggactggttcacgtcggtatagacgaaggtgtcggcaccgccgccgccggtcagatgatcggcgccgatgccaccgaagaacgtgtcgccgccgctgtcgccgatgaaggtgtcgtcatgggccgaaccgacccaggcctccacgttggtaatggcgtcggtgccgccggcatgcaccacgctggccgaagttccggtgacggtcgccgtgatccccgcccccatggccgagtagtccatggtgtcgacgcccgcgccgccgtcgacggtgacccccaccgaggccgaggcgacaaaaaagacgtcgtcatgcccggaaccgcgcaggatctcagtattggtgacggtgtcggtactcgcggaatgggtaaccacggccgaactgccattgagggtggccgtaatcccgcttcccatcgagccgtagcttaccgtatcggtcccggcgccggcatcgatggtattggacccaccgccaccaaccagggtgtcgttacccgcggcgccgtgaatggtgtcgttgcccgatcctccggtcagagtgaggtcgtcggaccggaaagcgccgtgaatttcaacggctccggtcgccgccgaggcgtctaccacattgaggcccgcgctctcggcctgcccccccagatagacggattgggccgcggtgatgctcgaggcgagggtcaacgtctcgatccccgtaagggcgggcatctggacactgcccatactggcggtgtcggagatgaccaccgtgtccagaccggccccacccaggatggacagccccgcactcagagtggccatgtcggtgaccagcttgttggtcccgctccccatgatcacttcggcgaagccgctgcctaccgtcagggtgctggacgcccccagggcggtcagggtagtccccgaggccgacacggcgaaggagccgtcggcgaaggtcagggtctcgatgccggtcagcgtgtcggtgccgtcggtaccgctgcggtccgtcaccgtcagggttccactgctggtggtcaggaggtagtcggcggcattgcccgtgaacaccgcgacgtcggcccccgcgtcgccgacgatggtgtcgttgccggcattgccggtgatggtgtcgttgccctggtagccccaaagatactcgccggctgaaccgccgttgatcacgtcgttgcccgtgccacccagcaccgtcacatgggccgaactggtgacgttgatcgtgaagccttcgctctggttgtcgaccttgaagtactgaccggccaccgaggcattggtgatgttgatgacctcgatgccctggagatgggtgtcgtcgaaattattgtcgtcgaaggtggtggcggtgatgaccaaggtatcggtgccgatgccgccattgatcaggggatcgccctggttggcgtaaatgacatcgttgcccgagccgccgatgaacgaatcagcccccgccccaccgctcagggtgtcgttgcccgagccgccgatgatggtcgccccttgggctccgccgaccaggaccacgtcgcccgacgcggtcgatccgtcgaggatgatgccttcgatgttgacgaaggtcttggcgctgatattcagcgtgcctgccgtggtctggtagaaggtgacggaatcgccgtcgcccgacaccgcatcgaccacggtattgactccggcggcggagacttcgtcgaaggtgatggaggaggttccggtcccggtggcgatgctttccaccgaggtcaggacgatcccggtcaggtcgaaggtgccgccgccatcggcctgcttgatgacatcggtgccggcaccgcccacgatggtggtgaattgctgcggattgacgccgccgcccaggatcacggtattgccgcccgccgccagggtcaggatttcgatccccgtcacggtcccggccgccagattaatggttccggcgtcgctgacggtcagggtgtcgagaccgccgctgtcgctgatggtgtcgccggcggtgaaattggcgacggaggataggtaggcgctggcgcccgccccgccatccagatgatcggttcccgccgtggtgacctgggttccgacagtcaccgccgagaaggcggtgccctgcaccgagccgccatggccgtcggtgatggtgtaggtgatggtggccgcgccggaatagccggccgtggcggtaaaggtgatggagccgtcggcgttcaccaccgcagtgccgtgatcggaatggccggaattcagcttgatggacagggcgtcgccgtccgagtcgcgggcattggccagcaactcggatttgctgaaggttatggatgttccggccgtgctgcccggcagggtgacatccgaggtggtcgggtcgtggttctgctgcaccggatcgggcttgggcgggtccgacttgggctccggcttaggctccggcttgggctccggcttaggttccggcttgggttccggattgggagtgggcaggccgaccggctgtggcggcaggggtggcggctcgggcgcggtattgtgcgtctcgccggtgcctgcattgcctgttcccgtattgcccgggccgccggtcccggtgcccgatggcgccgagggcaataccggcggtgcgacgggcggcggcgcgggcgacggcatgctggacgcgatggcggcgcctgcattggccgagaccgaccacgagccgccggatgaagcgccgacgatgcccgaaccggcggaattcagggtgaagctctggccgccgccgagagcgctgatcgccacctcgccgacgaagttggaaccgggatcgggcagcagcgccaccgaggtgttgccgtcggcggcgacggtgccgcccaccgtggtgccgcgaatgcccatggtcatgaccggggtggcgaggcgggcggcgtcgggctgggtcttggcgatatcgcccgagacgaagctgaacgccccctgggccaccaggaaggtttccttgccggtcttggtggcggggtcgtaggagaactcgtccaggccgaccagccccttgtccttcaggacgaaggtggtgcggtcggcgaagaccagggaaatctgggcgccttgggccgtctcgacggaatcgccctgcatcagcgccgcgccgatcttggccggcaccttctggccgtcatggacgatccaggcatcaccctggagcttgtccaccttgccgatcaccgtcgcggccggcttgtccgccgcggaaccctgggtatcggcgaccggcgtggcgagggttttcgccgccggaagctgtgacgggtcaatgggcatggcaccaatcccgaaagccggtcatcacggcgcgcccttccccgttctggagaaatcggaccatgccggccaatccagtctgaacgaattcagtgaaaaaatcatgtcattgcgcagcagcgggtccagaaccatacgcaagatggactttgacccgatgacgatggaggcggttcccgccatccctgagcgcaccggccaggccacgcccttgccgtccagcagctcggtcttgtccgagcggatctggaccttgtagtaggtggcggtggtggcgccccgggtctcctcgaaggaatcggcgccgaccatcaccacgtggccgggcagggcgccgaagcggaactggtcgtaggccgacaggcgcaccgaggcggcaaggccggggcgcagatggccgatatcctggggcggcaccttggcctccaccaccagggcgtcgtcgacgggaacgatgtccatcaaggtatcgccgggccgggccacctggcccacgctggcgatggcgctcatcttgacgatgcctctgaccggcgagcggatttccgagcgggattcccggtcggtggccacctccatggtggcgcgcagcgccgacagttccgcctcgaccttgccggtctcgtccagcaccccggcccgccagcccttttcgaactcggacagccgggcttcggcctcgctcatctgggccttgaggcgcgagatggaatcgcgggcggtggagacctcggtgtcgagcatcagctgctcgcgctccagcttgacgatctcctgattgcccaccacgccggaatcataggccttgcgcttgatgcgcatctcctcgacgcccttggcctgggcgcgggacagtccggtgaccttggtctcggtctccaccacctcgcggcggcggcgctcgatctcgcgcgagatcaccgtggcctgctgggcgcggtgggacagtcgctcggcatgaatggccagttcgcgctttcgcgtctcggcatcgatctccacgtcgcggggccaccggatctcggcgacgttgtccagatcggcgcgcagccgggcggcgcgggcgtgaaaggccgcccagcgggcccgcttgtcggccagatcgcccgccccctggctgttgatcaggcggaccagcacgtcgccctcggccaccagggtgccttcgtggaccagcacttccgagatggtgccgccctcgaaatgctggacatggcggacctggctggagggctcgatgcgggcctgggccgtcaccacctcgtcgatttccaggacggccgatccgcccaccagcaccgcgaaggccagggccgaccacaccagcagccacgaggccgagggcggcgtcagccggggcgcgatgccgtgaatgggagagcggaagctgtccatgggaccgtcggccatctcagcctcccgccggggcggggggagcacgccgcgtcacgtccagcagcttgccccggtcgaggcgcgccaccttggcggccagggcgaccacggcgggccggtgggaaatcaccaccagcgagcggttgcccaccgcctgatggatgccggcgatggcccgcttttccgaagcctcgtccaggaaggccgtgggctcgtccaggatggtcaccgccgcgccgcgcagcagggtgcgggccagggcgacgatctggcgctggccgcccgacaggttgcggccgccctccaccacctggaaatccagccccatgcccatgggcatgacgccgccggcccccagcatgttcatcatggcgatcatctgctcgtccgagaccagcccgtcgaagcacaggttgttgcgcaagctgccggaatagagcgggggggtctgcgggcagatgccgagatggcggcgcagatcggcggggtcgatcagggcgatgtcgacgccgtccagcagcacccggccggaaaccgggcggatgatgcccgacagcaccttttccagggtggtcttgcccgatcccgacggcccgatcaccgccagccgccctcccggctccaggtccagggaaatgccgtccagggccggattgaaggcgccgggatagccggcggtcaccgcctcgaccatcaggccgccgcgcgacaccggccggtgaatgagggcggacccggcgggacgctcggtggggcgcccggtgacggtgcgcagggcctccagcgacgccaccgccgacagggcctggggcaccaccgacaccatctgcatggcggcgccagtaaagcgggtggccagcatggtggcggccaggatcacgccggcgctcatgccgccctcgacggcccgccacgcccccagccccaccgccagcaacagcgccatgttctgggccagcatagagatgttgccgcgcgcggccgacagggtgcggatggcccgcgccgtggcggcgtaaagggcggtgccgtggcggaacctggcctggagataggcggcggcgccgacgcgccgcaccgtctcgggatcggaaaaggattcctgggccgcctgggcccgctggctggccgccccggacagctccttgtacagcagcttctggcgatgaatggccagcaaggtgcccagcgccacggccagattgagccccagcacggccagggcgatcagcgggtcgcacaggaacagccccagcaggaacagccccatgaacggcagatcggccagcagcgacaccgccgccgcccccaggccgtcgcggatggcatcgaaatcctgcagcatgcgcatcaggtggccgctgggcgccgccgccccgtcgaagcgggtctccaggatgcggcggtgcatgtccatggccaggcggatattgccctcgtgcagggcgtcttccacgaacagggcgcgcaggcggcggaacacctgctcgaacagggcggcgcccaggaacatcagcaccatcaccgccagggaattgagcaggccgtggggcagaacccggtcgtagacctgggcggaaaagatcggcgcggccagggccaggaaattggccagcatgccggccagtccggcgcgcaccaccatgggcttccaggacgccagcatggcggtccacgaggtgggctggacgctgtcggcgcggtccaggcggggccgcatgaacagcaggcggccgggctggccctcgggcggggccatgaccagggcacgcggctcgcccggccccaggacgacgcagggaaaaagatcggccgacagcttggccggattgacgccgtcctccacatgggcggcgaagccatagcgcgacagggcggtgatccacggcgcctcggcggcgtcggccgtggccatgcggtaggaatccttgagcgccgtcgccgccaccgcatgccccatggcgcgcaggcaggccgagacggcccgggccttgtcgtccagcccctccagctcaaccggcgtggggggcagcatcggcggtggtctccggcggcggggtgtcggtgaaggtctcggacggcggggcgtggtcgatgccctgggcggccttgagccgggccttggcgccttgcaggtcggaatagaggatgaagcggcgcagcgtcgacagcatgcccgaggcctccgccttgatctcctccatggcgctgccgctgcccgcctgcttggacttggcggccagcccgctgatgcggcggtcgatggcggccatctgctcggtcaggcggtattccttcagcgcgtggcggacctggatgtcggccacatgcacctgggtcagcaccgccatgcccatggccaggcgccgggtgcgggtggtctcggcggtgttctgggcgttgctgatccgcttgggcgccgagacgatatccatcaggttccaggccatgtgggctccggcgtcggcccaggcgttgtacttgatgaagctgttggaatcgtagtgcccgcccatgaacgggccgatgcccggcagggtcttcagcaattcggtgcggatctcgttgcggtcgatgcggaactgcacctcttcggacttcagctccgggcggttggccagggccaccgcctccatggcctcgacgctcgagtccgggtcctcggccgacaggaaggaatcgtccttcagctcggccagctcgaaggccgaggccgacggcatccccatatgcccggccagatcggccttggcggtggaggtctggcgctgcaactcggcgatctggcgcatggtgtcgacgatggcgcgctgatgccccagcatctgcatgggatcgcccaccttggtgcgctcggcggtctcggcgtcctccaccgacttgaccagccgggattccagggatctgtacttgcggttggcgaattcgttgatcaccgccttccaataggcggcctgaacgtcctggagcagcaggtgctgggcgcggcggcgcttttccgccgccaggaccaccttgtcctcctcctgatcggaacgcaccagggcgatgccgaaatccaccaggttccacgaggcggtcaggtcgccggtacggccgatcacatcctcgccggtgctgtaatcattgctgatggcgccggtgccgacatccttcgacgtagtcagcttcctcgggccgcgcttggaccatcgtcccttggcggccagttccggcagcatggcgaacagcgacatgtcggccttgccggcggccagaacctcctccagctccttgacccgtgcatcgagattgtgggccaccgccagcttcatggcgtcctcgaccgagagcggccgtttcagcatctcctggggcagggattgcgcatgccggttgatctcctcgcggatctcggccagatcctcgggcatgaccgagcacgcggacagcaatgccgccgtgctcacccccaggaccgcgttgcgaaaccccctccgcacggatacccccttcactcaaatcattcgaacccgacgctgcactatggccgaaggagtctgaatgtttcatgaagatcccacgctatcccattgttatagttaggcaaccgtcgatggtgaccagcggcgcacgctgaccagtccgctgcgccccttgaccttgttttcctcggcggcggaaaagccggtttccggcaggcccgaacggcgcagcgccagttcgtcgatgaccagttgaccggcctcggccagggagcacagccgggccgcgagattgacgctgtcgccgatcaccgtgaagtcctggcgctccttggggccgatggcgccgaggatggcctcgccgtcatacaggccgatgccgatggaccgcgccattgggcgcgccgccagatcggccagcagggcctgggcggcggccagggcgcgggcctcgcggtcgctgccttcgaagcggaccagcagggcgtcgccgatcatcttgtccacgtcgccgccatgggcggtgacgatttccacctggcgggtcatcagttcgttgaggaaatccaccgtggccttgggcggatggaactcggccaggctggagaaatcgcggacgtcggaatagaacagagtcatgccggcccgcgtggtcggcaccacgccgtcgggggacagccgcgccgccgcgccggcgctttgcgacacgaagcgctccaactggcggcggagattctgctgcacggtgacccggccgtcgatatcggcctgggccttgctcaccacccggtacagccagacgccgaaggccagcatgatgacggcgggcagcacggcgaagcgggcgaagctgtcgaagatgatgtcgtcgagaacgctggacggctcgtagacctcgaatgcgatgacgtggccgccgctttcgacgggaacatagatctcgtagagggagaggtcgccgcgagtggtggtctcgatctcgggccgcctgtcgcgcagcacgctgcgcagcaccgcattctcctcgcgcacgcccacgtcggcgctgtcggtggcataaagcgtgatgccgcgctcgttgaagatcttcaaggtgaagacgtggccgtcattggccaccgcctccagcagaaagcgggcgcgggcgccggccggatcggagagcaccgccgccggattgtcacctcccaccagccgcgcccaggtctcggcctcggccttctccaccagatgcacggtgttttccacccggcgctgggtggtttccaggtagacgcggcgttccagggaggtgaccgacagccagccgccgcccagcaggatcagggcggagaccgccagggccggaatcatccgggtgagatacaggcgacgaatgggaaacggctggtcgatgattccggtgatcatgcttgccccccgatggcagcttgaggaatgaacccaggggctaccctagccagccccggatgaacggggcctgaacggtgcgccatccgtctgccgcacggctgggctgtcgccacggcagatcgatattcttgggcatggcggggggaaacgtgatatctcaccgcgttgcttcccgcgccttcgcggaaagcccgggatcgcgctccccccatcgggccgggccgtcccctccttctgaagaaagcacccctctgtccatggatttctttcccgcgggtcatccgctgctcaaggctctgaccgagcgcgactacaccgatcccaccgccgttcaggaagcggttctcgagcccggcgccgccggccgcgacctgctggtctcggcccagaccggttcgggcaagaccgtcgcttacggcctggccattgccgacaccttgctgggcgacgctttcgtgctggagccggcggccgagccgctggcgctgatcgtcgcccccacccgtgagctggcgctgcaggtccaccgcgagctgacctggctgtacgagcatgccggcgcccgcgtggtgtcgtgcgtcggtggcatggacccgcgcgccgaacagcgcatgctgggccagggcgcccacatcgtggtgggcacccccggtcgcctgcgcgaccatctggagcgcggcggcctgcgcatcaaccgcctgaaggcggtggtgctggacgaggccgacgagatgctcgacctcggcttccgcgaggatctggaattcatcctggaggccacgccccaggagcgccgcaccctgctgttctcggccactttgccccacggcatcgtcgccatggccaagcgctatcagcgcaatgcctggcgcatcgccgtctcggccggaacccagggccatgccgacatcgaataccgcgccgtgcgggtggctcccaacgagatcgagcacgcggtggtcaacctgctgcgctatttcgagtcgcccaccgccatggtgttctgcaacacccgcgattccgtgcgccatctccaagccatcctgctggagcgcggcttcgccgccgtggcgctgtcgggcgagttgggccagaacgagcgcaacaacgcgctgcaggcgctgcgtgacggccgcgcccgggtctgcgtcgccaccgacgtggcggcccgcggcatcgacctgcccaatctgggactggtcatccatgccgagctgccccagaacgcccagaccctgcagcaccgctcgggccgcaccggccgggcgggcaagaagggcgtcagcgtcctgctggttctgctgtcgcggcggcgcaaggcggacatgctgctgcagaccgccggcgtccaggccatctggagcggcgcgccgtcggccgaggacatccgcaagctggaccaggagcgcctgctgaccagcccgctgctgtccgaggaaaacaccgaggacgatctggccatggccaaggccctgctggccgagcgcccggccgaggacatcgccgccgccctggtgcgcatgtaccgctcgcatctgcccgccgccgaggaagtgttcgatcccggccccggcaatccatcgcgggagccccgcgaacaccgcgagcgcgagccccgcccgccgcgggaaggcaaaggccccggcctgcccggcggctcggtgtggttccgcatgaatatcggccggcagaagaacgccgatccgcgttggctgatccccatgatctgccgccagggcaaggttaccaaggccgagatcggcgccatccgcatcttcgagcgggagacccgcttcgagatcgacgccggccacgccgaccgcttcgccaccgcgctacgccagatcgagaaggccgaagtgcgcatcgagcgtctggccgagcatgccgccgagcctgccgccgccgcccggcccgacgaccggccccgtccccccgccggggtcaagcccatggggccgaagaaggcgccctggaaggacaagaaggacggtcaccgcaagggcaagccggcctgaacgcacattgtgttgactctggagacgggtcggactaaaaaccgaccctcttcagatttctggagatcaccgcctccgaggaggcccgctggtccgcgagtttcgcgcaccggcgtgtaatcgtttatggacggatcatgttcgagagcttgagctcaagactgggtaaggtgttcgagaagctgacgggccgtggcgccctgtcggaagccgacgtcaccgatgccctgcgcgaggttcgcgtcgccctgctcgaggccgacgttgcgctctccgtggtcaaggaattcatcggccgggtcaaggcccgcgccgtcggcgccgaggtgatcaagtcggtcagccccggccagatggtggtcaagatcgtccatgacgaactgatcgccaccctggggaccaagggcaccgagctcaacctgtcggccgtgccgccggtggtcatcctgatggtcggcctgcaaggctcgggcaagaccaccacttcggccaagatcgcgctgaagctcaagaaagagaagaagaaggtcctgctggcctcgctggacgtctaccgtcccgccgcccagcagcaattgcagattctggccggacaggctgaagtgggcagcctgcccatcgtcatgggcgagatgccggtggccatctccaagcgcgccctggatgtgggccgcaaggaaggctacgacgtcgtcatcctcgacaccgccggccgcctgcacatcgatcaggagctgatggccgaggtcgccgccgtgcgcgacgccgccaagcccaccgagaccctgctggtcaccgatgccatggtcggtcaggacgccgtcaccctggcgcgtgaattcaacgagaaggtcggcgtcaccggcatcgttctcacccgcatcgacggcgacgcccgtggcggcgccgccctgtccatgcgcgctatcaccgggcggcccatcaagttcctgggcgccggcgaaaagctcgacgcgctggaagtcttccacccggaccgtatcgccggacgcattctcggcatgggcgacgtggtcggcctggtcgagaaggccatggagaccctggaccaggaagaagccgaacgccttgccaagcgcatggagaagggcaagttcgacctggacgacatgcgcaagcaattcgcccaggtgcgcaagatgggtgacctgaagggcatcctcggcatgctgcccggcatcggcaagatggccggcgccctgaaggacgccaatatcgacaacaagatggtcgcccgccaggaagcgatcatcacgtccatgaccaaggccgagcgccgtaatcccgacctgatcaaggcgtcgcgcaagaagcgcatcgccgcgggtgccggggtcgaggtccaggacgtcaataagctgctcaagcagtatcagcagatggccgacatgatgaagaaggtcggcaagctgggtcagaaagggctgatgcgacacggcatcggcggccttttgccccccggcatgaagttcgggcgctgaccggcgcccaaaggttatttgaggttcgggcggttctccgcccaaggttattcggtttcgaacagaggaagaccaaagaatggctctgaagattcgtctttcccgcggcggcgccaagaagcgtccgttctacaagatcgttgtcgccgacgcccgtgcgccgcgcgatggccgcttcatcgagaaggtcggcacctacaaccccatgctgcccaatgacaacggccagcgctggatcctcgacgaggaccgcgtcaagcattggctgtccgtcggcgcccagcccaccgaccgtctggtccgcttcttcgccgacaagggcctggtcgccaagccggtccgcgccgagcagaccaagcagccccagcccaaggccaaggcgcagcagcgcgccaaggaccaggccgagcgcgacgcggctgccgccgccgaagccgctgcgggcgagtaatcacccgtgggacctcgtgtccgcgtcggcgtgatcgtcggcgtccatggggtccggggtgcggtccgcatcaagagcttcaccgaggatccggccgatatcggcttttactccccggtggagaacgaggcgggcagcatcaagtatcggctgaaggtgacgggcgaggtcaagggcctggtcatcgccacgctggacgggattggcgaccgcgacgccgccgaggcgctgaagggcaccgaattatgggttgcccgcgagcgtctgcccagattggccgaggacgagttcctctattccgatctgatcgggctggtggcggaaggggttgacggcaaaaggttgggcatcgtgaaagcggtggccgattacggggccggtgacgtgctggacatcaagctggagccgaaaggcgacatgatggtgcccttcacccaggcctcggtgccggaagtggatattgcgggcggtcgtctggtggtggttccgccggtctacgcgcccgacgagaacgaggagaagagtggtggagcataaggagccctggcgggcgacgctgctcaccatcttcccagagatgtttccggggcctctgggcctgtctttggcaggccgggcgctggaggagggcaagtgggctctcgacgcggtggatatccgaggctttgcttcgggcaagcaccggtcggtggacgactcgcccttcggcggtggagccggaatggtgatgcgtcccgacgtgctggacgccgccatccacggcaccccagcgccggggcctctggtctacatgacgccgcgcggccggctgttgaaccaggatctggttcgcgagctggcggcggggccgggtgtgagagttctgtgcgggcgtttcgaaggggttgaccagcgcttgctggaagcccacggagcgctcgaggtcagtgccggcgatttcgtcctttcgggcggcgagccggcggcactggtgatgttggacgccatcgtccgcctgcttcccggcgtgatcgggaaggaggagtcgctggcggaagagagcttcgaatggggatcgctggaatatccccattatacccgcccccaggtgtgggacgggcgaacggtgccggaggtcctgctttccggtcaccacgaaaagatacgcgcctggcggaagcgtcaggcagaggacataacccggcagcgccggcccgatctgtgggatcggtacgtcgccgccaagaacctgagtgagggttgagccatggttaacatcattgagcagctcgagaaggagcagatcgagaagctgaccgccgatcgcggcgtccccagctttgctccgggcgatacgctgaaggtcaacgtcaaggtgatcgaaggcaaccgcgagcgcgtccaggcctatgagggcgtctgcatcgcccgcaagaacgacggcctgaactcgtccttcgtggtccgcaagatctcctacggcgaaggcgtcgagcgtatcttcccgctgtactcgcccaacatcgcctccatcgaggtggtgcgtcgtggcgacgtgcgtcgggccaagctgtactacctgcgcgaccgtcgcggcaagtcggcccgtatcgccgagcagaccaccggccattccggcaaggttgcggccgccgagcgcgccgacgccgccgccgtcaaggccgccaaggtggctgccgccaaggtcgagtagtctcgtcctttcggttccttggttcctgctcttccgttcagcctccttcccatcggggagggggctgtttcggggactggacgtttgactgggtggtgcggcctcttgccgacgggcgttcgcgtcccgagatatcaggccgcctgagtgctgcttcattctagggattcgacatggccaagctgcgcacgttgttcgacaagatctgggacgcccacctggtggacgtccaagacgacggtacctgcctgatctacatcgaccgtcacatggtccacgaggtcaccagcccgcaggccttcgagggcctggagatgtccggccgcaaggtgcgccatcccgagctgaccctggccgtcgccgaccacaacgtgccgaccaccgatcggtccaagggcatcgagaacgaggaaagccgcatccaggtggaaaccctggaggccaacgccaagaagttcggcgtggaatacctgcgcatggacgacatccgccagggcgtggtccacatcgtcggccccgagcagggcttcaccctgcccggcaccaccatcgtctgcggcgattcccataccgccacccacggcgctttcggctcgctggccttcggcatcggcacctccgaggtggagcatgtgctggccacccagaccctggtgcagaagcccgccaagaacatgcgcatcaccgtgaccggcaagcccggcccgggcgtcaccgccaaggacatcgtgctggccatcatcggcaagatcggcaccgccggcggcaccggctatgtggtggagttcgcgggcgaagccatccgcgacctgtccatggaaggccgcatgaccgtctgcaacatgaccatcgaggcgggtgcccgcgccggtctggtggcccccgacgagaagaccttcgcctatatcgccggtaagccccgctcgcccaagggtgccgccttcgaggccgcggtcagctactggaagaccctgttcaccgacgaaggcgcccatttcgacgccgaggtgaccctggacgcctccaccctggtgccgcagatcacctggggtaccagccccgaggacgtcatcgccatcaccggcaccgtgcccaaccccgccgacatcaaggacgaggccaagcgcaaggctgtcgaacgctcgctggactatatgggcctcaccgccggcatgaaggccaccgacatcgccatcgacgtggtgttcatcggctcgtgcaccaacggccgcatcgaggacttccgcgccgccgccgagatcttcaagggccgcaaggtcgccgccagcgtgcaggcgctgattgtccccggctccggtctggtcaaggagcaggccgagcaggaaggcctggacaagatcttcatcgaggcgggtgccgaatggcgcgagcccggctgctccatgtgtctggccatgaacgccgaccagttgaagcccggccagcgctcggcgtccacctcgaaccgtaatttcgagggccgtcagggccgcggcgggcgcacccatctggtcagccccgccatggccgccgccgctgccatcaccggcaagctcaccgacgttcgctcgctgtaaggggacttgggatatggaaaagttcaccacgctgaccggcgtcgcggcgccgctgcccatgatcaacgtcgacaccgacatgatcatccccaagcagttcctgaagaccatcaagcgcaccggtctgggcaagaacctgttcgacgagatgcgctatacccaggacggcaaggaagtccccgacttcgtgctgaacaagccggcctatcgctcggccaagatcctggtggccggcgccaatttcggctgcggctcgtcgcgtgagcatgcgccctgggccatcggcgatttcggcatccgctgcgtcatcgcccccagcttcgccgacatcttcttcaacaactgcttcaagaacggcatcctgcccatcaagctgccgcaggagcaggtggacaagctgctggacgacgccaaccgtggctccaacgccatcgttaccgtcgatctggcgcgtcaggtgatcaccggccccgatggcggctccatcagcttcgaggtcgatcccttccgcaagcattgcctgctgaacggtctggacgacatcggtttgacgcttcagcgcgaagacaagatcgcggcgttcgaagagagccgcaagacgtcctctccctggctgtagccgtcggatttcgtctctttccgtcgcttgacgggaccgtgtccaggcattaggcactcatccgttagacatagatattgttcgggagactagtatggccgccaagaagcttttgatccttcccggtgacggcatcggcgtcgaagtgatggcgcaggtccgccggatcatcgactggatgggccgcaagcggaagatcgagttcgagatcaccgaaggcctgctgggcggcgccgcctacgacgttcacggcaccccctacccggccgagacgctggaagccgccctggccgccgacgccgtgctgctgggcgcggtgggtggtcccaagtgggacgacctgcccttcgacaagaagcccgagcgcggcctgctgggcatccgcaaggacatggggctgttcgccaatctgcgccccgccaccgtgctggaagccctggccgatgcctcgaccctgaaggccgaggtggtctctggcctggacatcatgatcctgcgcgagttgaccggcggcctgtatttcggccagccgcgcggcatcgacaccctgcccgacggcacccgcaagggctacaacaccctggtctacaccacccccgagattcagcgcatcggccgcgtcgccttcgacctggccaggaagcgcaacaagaagctctgctcggtggacaaggccaacgtgctggaatgcaccgtgctgtggcgcgaggagatgatcaagctgcagaaggaagagttccccgacgtggaactcacccacatgtacgtggacaacgccgccatgcagctggtccgcaaccccaagcagttcgacgtcatggtcaccgagaacatgttcggcgacatcctgtccgattgcgccgccatgctgaccggcagcctcggcatgctgccgtccgcctcgctgggcgaggccgatgcccagggcaagcgcaaggcgctgtacgagcccgtccacggctcggcccccgacatcgccggcaaggacatggccaacccgctggccaccatcatgtcgttcgccatgtgcctgcgctactcgttcgacatggctgccgaggccgacctgatcgagaccgccgtcaagaacgtcctgaagggcggcctgcgcaccgccgacatcatgcagcccggcaaggccaaggtctccaccaccgtcatgggtgaagccgtggtccgcgagctggacaagctgaacgcctgatccttgggcgacgaaaaaagagcggcggtcccgaaaggggccgccgttttgttttgggggaagggaaaagatgcgaagggactcgtcccttcacgcatccctggtcctcgtgagaaaactgatggtgcggaagctgtgcttccacgcgggcgcgggcggccgcccgctcgcgaagcgatctcggcctactgcccgtcgtcgccgtcggtggggaactcgtcctcggccggggcgtggtcgatgtcgcggcggacttccggcgagttgaggatggaatcgatccgggacgcggtgtcgaaggtggtgtcttcctggaaccacagatcgggcacggcgcgcagttcgaccatgcgcgagatttcgtggcgcaggaaggccttggcgcgcttgaggcccgccaggatcggcgccacgtcgccgccgcccaggggaacgacgaagacggtggcgttgcgcaggtcggggctgacccggacctcggtcacggtgatggcgcggcccagcaggtcgggatcgcggaactctccgcgctcgatcaccatggcgatagcatggcgcagttcctcgccgacgcgaagctggcgctgggacggtggcttggcaccccggctcatggcaatgactccgccgcgaggaacacgatcaccccgttacagggtgaccgcgatctcctcgatctcgaagcactcgatgacgtcgccgacccggatgtcttcgtagttggtgaaggacatgccgcactcgtagccctcgcggacgtccttgacgtcgtccttgaagcgcttgagctggccgaggtcgccggtatggatgaccacgttgtcgcgcagcaggcgcaccttggccccgcgcttgacggtgccctcggtaatcatgcagcccgccaccttgccgaccttggtgatgttgaacacctcgcggatggacgcgtagcccaggaacttctcgcgcagttccggcgccagcatgcccgacagcatcttcttcaggtcgtcggtgacgtcgtagatgatggagtagtagcggatgtcgacgccatcgcggcgcgccatgtcgcgggcctggggattggcgcggacattgaagccgatcagcaggccgttggaggccttggccagggtgatgtccgactcgttgatggcgccgacggcggcatgcaggatgcgcaccttgacgttctcgttgcccatcttctccagggtggaggagatggcttcgatggagccctgcacgtcgcccttgatgaccaccggcagttcctgggcctcgcccgacttgatggccgagaacatctgttccagggtgccgcgctgggccaacttggccttggcctcgcggtccatgcggctccggtagccggcgatctcgcgggcgcgggcctcgtcctcgacggtgacgaagtcgtcaccggcggcgggcgtgccctgcaggccgagaacctcgaccggggtggagggaccggcttccttgatggaattgccgtggtcgtcgaccagggcgcggacgcggccccattcggcgccggccacgaagacctcgccgaccttcagggtgcccttctggaccaggacggtggccaccgagccacggcccttttccatcttggcctcgaccaccacgccctgggcggcgcgggtcgggttggccttgaggtcgaggatttcggcctggagcaggatggcttcttccagcttctcgaggttcaggcgctttttggcggagacctcgatggccaggacgtcgccacccagttcctcggtgaccagttcgtgctgcagcagttcctggcggaccttttccggggtggcgcccggcttgtcgatcttgttgatggcgacgatgatcggcacgccggcggccttggcgtggcggatggcttcaaccgtctgcggcatgatgccgtcatcggcagccaccaccagcaccacgatatcggtcaccttggcgccgcgggcgcgcatggcggtgaaggcttcgtggccgggagtgtcgatgaaggtgatcttgtcgcccgagctcatggtcacctgataggcgccgatgtgctgggtgatgccgcccgcttcgcccgacaccacgtcggtggcgcgcagcgcgtcgagcagcgaggtcttgccgtgatccacgtggcccatgacggtgaccaccggcggacgggtgaacagcacctcgtcggtatcggcctcgccctccaggccgaccaggacgtcggcttcggagacgcgcttcatgttgtggccgaactcggtcaccaccagttcggcggtgtcggcgtcgatattctggttgatggtggccatcacacccagacgcatcaggcacttgatcacgtcggcgccacggacggccatacggttggccagctcctgcaccgtgatgctttcgggcacgatcacctcgcggatgaccttttccgaacccttctgcatgtgcttgaggcgctcacgctcgcgggcgcgcttgacggcggccagcgaccggccgcgctcggagcggtcgtcatcggtcagcgcgtcggtgatggtcagcttgccggtgcggcggcgcggctcggtacgcttgaccggggcgggcttgtgggcggcggcgcgcttcttggcgcgctcctcttcctcttcctcttcctcggtgcgggcccgcggaacggcggtggcatcgccggcgggagcggcggcggccacgggcttgggctgagccggagccaccggggtggcgggggcgggagcaggagcggcggcaaccggagcggtgggagcgaccggctcggcggccggagcggctgcctcgggctcggactgcggctcggcggcgcggcgggcggcctcttcctcggcgaggcgagcggcctcttcctcggcggcgcgggcggcctcttcctcggcggcgtggcggatggcctcctcctcggcgcgggcgcggacctcttcctcgtggcggagagcgtcctgcagcgccttggcgcgggcggccttctcgccggtggtcaggtcatgggcgctggcggcgcggctggcggcctccaccttggccacggcggcggcgagatcggcctcggcgacggaatggaccccgtccttgatctcgtgcatggcgccgccggcgctggtgaaggtgcgctttttgcggacctcgaccgtcaccaccttggaccggccatgggagaagctctgccggacctgtccggtctcgacggtcttcttcagctccagcttgcccggctgggtcagcttcagcggggccttacggtcttgatcctgggaatcgctcatgtacgacttcgtctcttctgcaaaaaatcatccgcgaaaaccggcaagcaacgccgcgccatccttgagacgctgcgccagcctgcccggaagcacgcagacatgaacggccgcatcgcggccaaaaacggtgcccaactcggcgccgtcaaaaagctcgatcgccggcacgccgggtgccatggcctgaaccttggcgcgcccgtcgcgggcggcgtccctggccccgagaagcacggcggcgcggcgagccttgatctcggcgcacaccttctcgaacccacagaccgcctgaccggcgcggcgcgccaggcccaggacatccaggcaacggcgcgccaaaagcgcttcgacccgatcggccagatcctcagggaccaccacctggcggcgagccacccgggcgaaggaccgtttgaccacggccgtatttaccacatcccggctggcgctcaaccagattccccgtccgggaagctcatggccggggtccggaaacagcgtaccatcaggcgccacggcgaaccgcagcaattccgacttgggtcggacctgaccggtgacgatgcaccggcgttcgggtccgacctcttcttcttcgtccaagtcgggggattcggccatgccgctccccttacttgccttcctcgaaccaatgagcacgggccgccatgatcacggcattggcctcgtcctcggtcatggcgtccttgcccaggatgtcgatcagctcgtcaccggccagatcgcccaggtcgtccagggtcttgatgcccttgtcgcccagcttgaccagcatggacggagccagcccctcgatggcggccatctcgtcggcgacgcccatgtccttgcgcatctggtcgtagcgctcgtcctgctcggccaggaagttgcgagcccgggtctgcagttcctcggcgacgttctcgtcgaagccctcgatgtcggcgatgtcctcggccggcacgtaggccacctcctccaccgacgagaagccctcggtcaccagcagatgggcgatgacgtcgtcaacgtccagggcctggatgaacatattcgaacgcgaacggaattcctcggtgcggcgctcggattcctcggcctcggtgaggatgtcgatgttccactgggtcagctggctggccagacgcacattctggccgcgacggccgatggcgagagacagctggtcgtcgggcaccaccacctcgatgcggccggcttcctcgtccagcaccaccttggtgacctcggcgggggccaggccgttgaccacgaaggtggcgacgtcgggcgaccactggatgatgtcgatcttctcgccctgcagctcggccaccacagcctgcacgcgcgagccgcgcatgccgacgcaggcgccgacggggtcgatggaggaatcgtgggacagcacggcgatcttggcgcgcgagcccgggtcacgggccaccgccttgatctcgatgatgccgtcatagatttccggcacttcctgggcgaacagcttggccatgaagatgggatgggtgcgcgacaggaagatctgcggcccccggggctcctggcggacatcgtagatataggcgcggacgcggtcgccggtgcggaaggtctcgcgcgggatcagttcgtcgcggcgcagcagcgcctcggcccggcccagatcgacgatgacgttgccgaactcgacgcgcttgaccagaccattgctgatctcgccgacgcggtccttgtattcgttgaactggcgctgacgctcggcatcgcgcaccttctggacgatgacctgcttggcggtctgggcggcaatgcggccgaaatcgatgggcggcagcggatcgaccaggaagtcgccgacgacggcgtcgggcttcttcttcagcacctgcttcagggtctgctgggtggcctcgttctccacctcctcgaccacttcgatatagcgggccagctggatttcaccggtcttgcgatcgatatgggcgcgaatgtcgtgctcgtggccatacttggagcgaccggccttctgaatggcctgctccatggcttcgagaacctcgtcgcggtcgatgcccttgtcgcgggcgacggcgtcggccacctgaaggagttcggggcggggcagtgcggcgatccgttccatggtcctacttcgtcctcactcttcctggtctttcaacgtcgcggcgatcagttcgtcggtcagcaccagcttggcaccgcgaacatcagccagcggaatggcaatctctccggcggcctcgatgacgagacgcacattgacgcccgcctcgtccagccccagcagcttgccccggaaccgcttgcgcccgtcgatgggctggcacgattccatcttggcctcgaaccccgcccatgcgacgaagtccttggcccgggtcagcggacggtcgatgcccggcgagctcacctcgagggtataggccgccgagatggggtcctccacatccagcagggccgaaaccgagcggctgatgtcggcacaatcgtccacggccatcatcacgccgtccttgcggtccgccatgatctgaagcgtgagccgctgctttccctgcagctgcacccgcaccagctcgtaccccatggcgtccagtgacggcgcgatcagggcctccaaacggctttgaagatccataaccctgtcgcctgcgaccttaacgttggtccctaaaaacgaaaaaagtgggccactggcccaccctcacaatcccgtctgacgggaatacaagaatgtgtcttggcgtcaatatagccaaatcggcgcccgaggcaagaagcttgtggcatcccccctacttcttcagaatcctcggcaccgaattgaggcgcagacggaaggcgtcgggcatgcccgagcccagcagcggccgcagatacatgcggaaggcatcggtgacgtcggtgcccgactccgcgatgaagtggtcttccatcacccttgtcttgccggccaccgaggccaggggcagcagcttgtaatccaccgagtagaaaccggtgcgctggatggtcaccgagccgtcctgatcgccccacatggcgaattgcactgccttttcgcccacctcgcgggcctcgcgctggtccacgtccgagacgcagccgatgaacgagcgctggagatagccgaaggtgtcgccccgcacccgcttgatgccaagcttgcccttcacctcctcgcacagcaggtcggacagcgccccggtccccgacagctggatattgccgtgggcgtccttttccgtcgccttgctcagggtggtgacgatgggcgttcccttctcgtcgtgcacgccttcggaaatggccaccacgcagcggccatgcttgtcgtaggccgccttgacgtcggcgaggaagctttccacccggaacgtccgctcggggatatagataaggtgggggccgtcttcgggaaacttcttgcccagggccgaggccgccgtcaggaaaccggcatggcgccccatcaccacggcaagatagaccccgcgcaacgccgcattgtccagattgacccccatgaaggcctgggccacgaagcgggcggccgagggaaagcccggcgtgtggtcgttcagcaccagatcgttgtcgatggtcttggggatgtggatgcagcgcagggggtaatcggctgccttggcctcctcggacacgatgcgcacggtgtccgacgaatcgttgccgccgatatagaagaaataggcgatgccgtgggcgcgcagcacctcgaagatctcgtggcagtacttgcggtccggcttgtcccgcgtcgaacccagcgccgaagacggcgtctgcgccaccatttccaggttgtggctggtttcctgggtcagatcgaggaagtcctcgttgatgatcccccgcaccccgtgatgggcgccgtaaaccagatccacgttgcggaacttgcgcgattccaggacggcccccaccatggactggttgatcaccgccgtcgggccgccgccctgggccaccagaaccttgccgtgcagcatggaacgcctccctcttggtgctgtctcaggatagcccctttttgtcgggccgccagcgaccaatatgagggggagccccccgcctcgaaaggataggccttgcccgctccgccgcttcgcatcttcgattcgccgtgcaaatccgtctgccgcatggatgaccgcttcggctggtgcgccggctgcaagcgcacaaggtccgagatcaaggcatggcccaccgcaagcaatgaggaaagacgcgccattctcgacaatcttccgagtagatcagccgaagaaacacgggtactgggcggcctcgatagctggccgtcacaaaaccgtaacaattagatactgtttgcctcgccggtatagctggaacacctccccattcatggtgtatttacacgcgccatggggttaatcccgtaggaggggagttccggaaatgagcagagtactgtcgcgcttttcattgaaggtgcagatcgggtcactggtggcattggccggactcgttcttggcatatgcatggcggtgctgtggactgcccgtggcgccaccgaggaggtcaaccaccacctgaaccgggaaaccgccatcgcccagcgcgccgccagtctggattccgcccttctcaatgcccggcgcaacgagaaggacttccttctgcgccgcagcgacaagtacgcggcagagcatgccaagaccatcgccgccgccctcgccgccctggctggcatcgcggaagccctgcccgaaggcgatgggcgtcgcctccagctcgaggccgtgcgcaagggcgccgcggattacacccaagcgttccggaccgtcacggaaaacgagatccgggtcggactcagcgagaaggacggattgctgggcgcgctgcgcacctcggtccacgaggtggagaccgccctcaaggcccatgacgagccccggctgcagatcctgatgctgatgatgcgccgccatgaaaaggacttcctggcccgcctggactccaaatacatggacgacctggccaagcgcggcaccgaattcgacaaggccctggccgcctccgccctttcctccgccgaccgcgcccccatcgccgagcgcatggccgcctatcagcgcgatttccggctggccgcccaggccatgctggactcccgcgattcggccaaggtgatgagcgagacctatgccgccatggcccccgccgtccaggccctgggcgatgccgcccgacagggcatggaggccgcccgcgacgaggccgaccgcgtcaacctgtcggccggacgcgccatgacctgggttatgctggcaggctttgccgccatgctggtgatcggcactgctatcgcccgctccatctatcggccgctgaccgccatgaccggcgtgatgggccggctggccaagggcgacatgaccgtcgagattcccgaccaggaccgcggcgacgaagtgggcgccatggcccgctcggtccagcggttcaaggaggacctgacggaagtggaacgcctgcgcgcggcccaggaggaggagcgccgcaaggccgagcgcgacaagatcgccgccctgcagggcatggcggagacggtggagcgcgaaacccgcgctgccgtcgaccgcatcgccgagatgacccggcgcatggccgacaatgccggcggcatggcccttagcgccagcgcggtgggcgacaactcccaaagcgtcgccgccgccgccacccaggccctggccaatgcccagaccgtcgccgccgccgccgaggagctttcggcctccatccacgagatcgccaatcaggtcggcaccgcctccaccgtgaccagtaccgcggtggaagcctctaaccaggccagccggaccatctcgcaattgtccgagacggtgaaccgcatcggcgaggtggccaatctcatcaacgacatcgccagccagaccaatctgctggcgctcaacgccaccatcgaggctgcgcgggcgggcgaggccggcaaaggttttgccgtggtggccaacgaggtgaagaacctggccaaccagacggccaaggccaccgaggaaatcaccgcccagatcgtcgccatccagaccaccacccaggatgcggtccgttcggtgggcgagatcacccaggccatcggcgacgtccagggcgtgtcggcggcggtggctaccgccattgaggaacagggcgccgccacccaggaaatcgcccgcaacgtggcccagacctcggacgccgccaacgaggtggccgaccgcatcgccaaggtctcgaccgaggccgcccataccggcgagcgcgccgcccaggtgggcagcgtctccagcgaggtggccggcggcatcgaccacctgcgcgagattctgatccgggtggtgcgcaccgccaccaaggaggtcaaccggcgccacaagccccgctatcgcctggacgccgacggcaccatcaccgccgggggaagcgtcatggcggcgcggatggtcaactgttccgagggcggcttcaccgccgctggggattttcccggcctcagggcgtcgagccgcgtcgagctgaccctgcccggcatccccttccccctggcggcggtgatcaaggatttcgagcacggccgcctgcacggcaagttcgagttccccgaagcccagatgggaaattggaccgaggccttcgcccgtctggtggcaggtctcagcccgctggaggatgcggcatgaatttgaatcggttagccggggttcttcgcaatccgattcagatagccgttgactctgccccgggggtgagtatatttcggccctctcgcgctaggcccaaaccttgcgcgccactatttcttttgctcaggtagaatcgtcatgttcgcagtcattcagaccggcggtaagcagtacaaggtcgcttcgggcgacgtgatccgcgtcgagaagctggccggcgaggccggtgccgaggtcgtgcttgatcaggtgctgatggtcggcgacaagatcggcgtcccggtcgtggccggcgccagcgtgaaggccaccgtggtggcccaggcccgtggcgagaagatcatcgtcttcaagaagcgccgccgccagaattcgcgccgcaagaacggccaccgccaggacctgacgatcctgcgcattaccgacatctccgccggctgattgcccgagcggatacgaggagactaggacaatggctcataaaaaggctggcggctcatcccgcaacggtcgcgactctgcgggtcagcggctcggcgtcaagaagttcggtggcgagctggtgattcccggcaacatcatcgtgcgtcagcgcggcaccaagttctatcccggcaccaatgtgggcatgggcaaggatcacaccctgttcgccaccgcgatgggcaaggtgagcttcaagcacaaggccgagggccgcaccttcgtggtcgtggagcccctgccggaggccgccgaataaggccgttcccggacgcttgcgtttttaagaaaggggaacggttcgccgttccccttttgcttttggatatacccccatgaagtttctcgatcaggccaagattttcgtgaagtcgggtgacggcggcgccggctgctgttcgttccggcgggaaaagcacatcgagttcggtggccccgacggcggcgacggcggccgcggcggcgacgtcatccttgaatgcgtggccaatctcaacaccctgatcgactaccgctatcagcagcacttcaaggccaagatcggcaatcatggccagggccgcaacaagaccggcggcaagggcgatgatgtcatcctgaaggtccccgtgggcacccaggtgctggacgaggagaaggaaacggtgctggccgacctgacgagcgccggacagaccatggtgctgctgcggggcggcgacggcggcttcggcaacatgcactacaagtcgtccaccaaccaggcgccgcgccgcgccgacgagggctggccgggcgaggagcgctggatctggctgcgcctcaagatgatcgccgacgccggtctggtggggctgcccaatgccggcaaatccaccttcctggccgccgtcacccgggcgcggcccaagatcgccgattatcccttcaccacgctgcaccccaatctgggcgtggtcaccctgggcgaggaagagttcgtcatcgccgacattcccggcctgatcgagggcgctcatgaaggcgccggcatcggcgaccgctttctcggtcatatcgagcgctgccgcgtgctgctgcacctgatcgacggaacccaggacgacgtggccgaggcctaccgcgtggtgcgtcacgaactggcggcctatggcggcggcctggacgagaagcccgaggtggtggcgctgaacaagtgcgattcgctgaccgccgacgacatcgaactgaagctgatggaactgtcggaagcctgcggccaggaggttctgcccctatccggcgtgtcgggcgtcggcttaaagcccatcctggcccgcctgttcacccatatccgcgaggcccgcgaggcagagcccgccgtgccggccgcctcgcccatcttcggctcgtccaagcgcggcgcccccaccttccagcagaggaagcgcaagctccaggccgaggacgacgagttcgccggcggacattggggcgccgacggcgagtggatctggcactccgccgataacgacggggacgaggtggacgaggattacgacgacgaggacctggaagaggtcgccgacgacgaagaggacgacgccgaggaatgagcccgcttgccgccgccaaacgcctgatcgtcaagatcggctcctcgctgctggtggatgattccaccggccaggtgcggcgcggctggctggaaaccctggccgccgacatcgccgcctgcaaggcgcgcggccaggaggtgatcgtggtgtcctcgggcgccgtggcggtgggccggcgcaagctgggactggttcctcccctcaagctggaggagaagcaggccgccgccgccaccgggcagattcgtctggcccatgcctggcaagacgccctggcccaccaccagatcaccgtggcccaggtgctgctgaccttggacgattccgagaaccggcggcgctacctcaatgcccgctcgaccctggaaaccctgctcaagctcggcgcggtgccggtgattaacgagaacgacacggtggccaccgccgagatccgcgtcggcgacaacgaccggctggcggcccgcgtcgcccagatggtctcggccgacgccctggtgctgttctccgatatcgacggcctctataccgccgacccgcgcaaggaccccgatgcccgcttcatccccgaggtgcacgagctgaccccggagatcgaggccatggccggcgatcccggctcggcctacggctcgggcggcatggtcaccaagctggtggcggcgcgcatctgcctgtcggcgggctgccgcatggccatcacccggggcgagcccatgcaccccctgaagaccatcgaggacggcggccgctgtacctggttcctgcccaattccgaaccccgcacggcgcgcaagcaatggatcttcggctccatgaagcccaccggcaccctggtgctggatgcgggcgccgcccgggccctggcccagggccgctcgctgctgcccgccggcatcaccgaggtgagcggggccttcgagcgcggcgattgcgtgctggtcaaggacggctcgggcaaggtgctggggcgcggcctggtggcctattccgccgacgattcccgcgccatcatgggccgcaagtcgggcgagatcgaagccatcctgggctttcgcggccgcgacgaactgatccatcgcgacgatctggtgatggagggatgaggtgcgcctgttcctcctccccctccttctcctttcgctgctggcccagcccgccctggccggctgcctgatcgccctcgatatcggccattaccgggacgcgccgggcgagttcagcgcgcacggcgtgccggaactgaccttcaacacccaactggcccggcgggtcggatgggagctggaccgccagggcgtcgcctggaccctgatcaatgccgaaggcgacatcacggagctggccgagcgcccccgccgcgccgcccggaggggcgccagcctgctgctgtccctgcatcacgattccgtgcaggacatctacaagaccgagtgggtgtggcagggcgagacccgcgcccattccgaggtgttctcgggcttcggcctgttcgtctcggccgccaatccccggcgggaggaaagcgaagccgtcgcccgcgccatcggcgacgccctgctggcggaagggcttcggcccagcctgcatcacgccctgccggtggagggcgagaaccgccccctgctggacccggcgcgaggcctgtaccgctatgacgggctggccgtgctgcgtcaggccaccatgccggcggtgctggtcgaggccgggatcatcgtcaaccgggacgacgaacctctcatcgcctcggagccctaccgcgccgccttcgccacggccatcgccgccgccgcccgcgcccattgccaacgcctgaactgattgagtaccgtgaggacatgatgaccagcaccgacctcgacgcattgatgaccgatctgggccagcgcgcccgcaaggccgcccgcatcctggccctgaccccgtcggcggccaaggacaaggccctgcgcgccgcggcccaggccatccgcatcgataccaagctgattctggccgccaatgccaaggacatggaagcgggcgaggccaagggcctgagcaaggccatgctcgaccgcctgatgctcaatcccgcccgggtcgaggccatggccaaggggctggaggatatcgcccggctgcccgatccggtgggacgctccctggccgaatggacccggcccaacggcatgagcatcgcccgtatcgccgtgccgctcggcgtcatcggcatcatctatgagagccgtcccaacgtcaccgccgatgccgccgccctgtgcctcaaatcgggcaacgccaccatcctgcgcggcgggtccgagagctttcattcgtcccaggccatcctgacggccttgaagggcggcttcaccgcctgcggcctgcccgccgacgcggtgcagatggtccccaccaccgaccgggcggcggtgggggtgatgctgcggctttccaactatatcgacgtcatcgtgccccggggcggcaagtccctggtggagcgggtggtggccgagagccgtatcccgctgttccagcacctggaaggcatctgtcacacctatgtggacggctcggccgatctggagatggccaagaccatcgtgctcaacgccaagatgcgccgcaccggcatctgcggcgccaccgagaccctgctggtggaccgggcctgtgccgggacccatctggcccccctggtcgccatgctgattgacgcgggctgcgaggtgcggggcgacgccgtcgcccaggccgccgatgcccgcgtgatccccgcctcggacgccgactggagcaccgaatacctggacgccatcatctcggtgggcgtggtggacggagtcggcgcggcggtggagcacatcaacacccatggctcgcaccataccgaggcgatcgtcgccgaggattcccaggtcgccgagaccttcctgaacggctgcgactcggccatcgtgctgtggaacgcctcgacccagttcgcagatggcggcgagttcggcatgggagccgagatcggcatctccacgggcaagatgcatgcgcgcggcccggtgggcgtcgagcagctctgcaccttcaaatacgtggtgaagggcaacggccaggtacggccggggtgagccgtcgccggctcaatccctggggcgagccccgccgggcgcgggtcgggctgctgggcggctcgttcaatcccgcccacgaggggcaccggcatatcgccctgctggcgctgcggctgctgcagctggacgaggtctggctgctggtcagcccgcagaaccccttgaagccggtcgacggcatggcgccgttgccggaacgcctcgcctcggcccgggccatgacgggcgggcatccggccttgcgcgccagcaccatcgagacggagtggggcacgcgctataccgccgacaccctggcggtgctgtcccggcgctttccccgcatccgcttcgtctggctgatgggcgccgacaatctggccggatttcatcgctggttgcgctgggagtccatcttccggtcggtccccgttgcgattctggcgcgcggcccctattctgcgcgaaccctgggcagccgggcggcccatcgcttcgccgcgagccgcctgccgtcgtcgagggcacgatttctgtggcagggaccggcacccgcctgggtgttcctgcatacccggcgccacgccgcctcatccaccgccatccgcaacaggagagacccatagcacgcaaacccgccgccaaggccgaatccgccccggttcccgaacccgctcccgcccccagtctggcggagctggtcgcggccaccctggaagaccacaaggccgagggcgtcatcgtcctggacctcaagggccgcacctccatcaccgacaccatggtcatcgctaccggcaagtcccagcgccaggtgggcgccatggccgaccatgtggaaaaggccctgaagcaggccggacagaaggtcaccatcgaaggcatgccccagtgcgactgggtgctggtggatggcggcgacatcatcgtccatctgttccgccccgaggtgcgcagcttctacaatctggaaaagatgtggggcgcgctggaggcaaaagccgacgcccccaccgcctcggcggtgcgcgccaaggcgatcgaacagggctgatgcgcctgctgatcgccgcggtgggcaaggccaaggccgggccggagcaggacctgttccgccagtattgccggcgcctgtctcctccccccgtcctcaaggaggtggaggagaagcgccccctggccggacctcagctcaaggcgcgcgaggcggaactgctgctggccaccctgcccgagggcgccaaggtggtggcgctcgatgagaaagggcgcgacatcggctcggtggatttcgcccacaggctgcgcgactggcgcgattcaggctgccaggacgtggccttcctcatcggcggcgccgacggccacggcgacgcggtgagggagcgggccgacctgctgctgtccttcgggcgcatgacctggccgcacatgctggtccgcgccctgttggccgagcaattgtggcgggcccattcgatcctgaccggacacccctaccataggccataaccaatggccatatgaccatgggctcttgaaattcttccgttcatggcgcaaggatggcggcggggaatctgcttggattccaaggaggggtggtgacggaaactgatatcccgccggaagagcgggcagccttcgaggaatacgttgccagggtcggcggcaccaacatcagcgcccagacgctgctggccaccgattatctcaaccatttcaacgagatcgtcatgctgctcgacatgattccggatatgccggacatgatcgaggagtgcaagatgtgggctcccaagagctaccaggagcatttcgccgattccaccttcaaggacaagctgctggcggtggaggcctatgaccgcgtccccaccaagttccgtcgtcccttcgaggaaaccatcaaccacttgaacaccctgatcctggggggggttgccaagctggaagaggaaatcgtcaatggcgccgacccggcgctgaccaccgagcacgtcaaggccatcagccgcgccgcccaggccctgatggattgcgccaacgccatcatccacggctcgaaccgcgccatggcccaggtggaaatcgacggcttgctgggcgggacctaagccttcctggccacccagccgccgaagcacagcgcccggaaatagggctccggcggaccgaagccggtttcggccaacaattccgccagccgcgcctcggtcagcgggaagatgtcgcgatccacgtgacggaagcccttctccacctcggcctcgggaatgccggccgccagttgcaggtggcgccaccaggcgcgcagctgctgctgccaggcatcgtcccaggtgccgaacagatcggccagaaccagcggcgcacccggcttcagatgggcggcgatttcctccagcagggacttcttggccccgtcatcgggaagaaaatgcatgaccagcagcaaggtggcggcgtcgaagggctcgaacttgggcaggtcccccaccttggaagggtagagccgcacccgggcggtgaggttgtgctccttcaccttggcctcggcgtgatcgagcatgtccttggaggggtccacccccaccacggaaagattggggcagctttccgccagggccacgcattccacgccggtccccgccccgatcaccagggcgcggccggagccggaggtggtctcggcgacgatctggcacgacaggacatgcagggcgtcatagccgggaatggcttcgcgcacccgcttgtcataggccgcggcgcgggcatcgtcccagtgcttgacggtatcgcggctcatgcgtcctcactcccttcttgcggaaatccgtccaggcgtctcagggcctcggcggtggcgatggcggcggccagcgccacattgagcgaccgggcccccacctgcatgggaatgcggatgcgcgcctcggcccgatcgaccacgtctggcggcacgccgcagctttcccgtcccaccatgatggtgtccccgggcgcgaaaggaaagcggtcatgacgcacggcgccgccggtggtcagcagcaccagccggcgcccctgggcggccagggtggcggcgaagacctcccacgaggtatggcgggtgtaactggcctggtgaatataatccattccggcccggcggactttacgttcatcaaggacaaagccgcagggttcgactatatccagcggcacgcccaggcaggcggacagacgcagcagcgccccggcgttctgcgggatgtcgggctggtacagggcgagtcgaaggggttccaagggcatctcgatgacggattcttgtgcagtgcggcagcgcttggcagcacggcatattagactccgcgcatgcaggtcgagacggctgttgaaacgactcggacgatgtggttaatagtcgcgcttccgcgggccaacaagaggattaatcatggctgatcaggcacacaatgcccagccctcgtcggtggacgggcagacacggcgggatttcctgctgtacgccactgccggcgtcggtgcgattgggactggcttggcactttggccgttcgtgcatagcatgaacccggccgccgatactttggcgctttccaccaccgatgtggacatctcggccatcaagccgggacagtcggtcaccgtggtgtggcgcggcaagccggtgttcatccggcatcgcgaacccgccgagatcgacgaggccggcaaggtggcgctggccgacctgcgcgagccgcaagccgatgccgaccgcgccaagaagcccgagtggctgatcctgatcggcgtctgcacccatctgggctgtgtgccgctgggccagaagcccgccgacccccggggtgaattcggcggctggttctgcccgtgccatggatcgcactacgatacctccggccgcatccgcaagggtccggctccggccaacctgccggtgccgccttatcagttcaccagcgacaccaccgtccggatcggctgaggggacccgtcatgagcgacttcaagagcaacaacaaggtcgtcaactggatcgaatcgcgtctgcccatcttctcgatgatgcagcacagcgcgatcgattacccgacgccccgtaatctgaactactggtggaacttcggttcgctggctgcggtgatgctgatcatcatgatcctcaccggcctgttcctggccatgaactattcctcccacacctcgctggccttcgactcggtcgagcgcatcatgcgtgacgtgaattacggctggctgctgcgctacctgcacgccaacggcgcctcgatgttcttcatcctggtgtacatccacatcttccgcggcctctattacggctcgtacaaggccccgcgcgagatcctgtggttcgtcggcatcgccatctacctggcgatgatggcgaccggcttcatgggctacgtgctgccctggggtcagatgtccttctggggcgccacggtgatcaccaacctattctcggccttcccggtggtgggcgagttcatcgtcaccctgctgtggggcggcttctcggtggacaatcccaccctgaaccgcttcttcgcgctgcacttcctgctgcccttcatcatcgtgggtctggtcgtggtgcacgtgtgggcgctgcactcggtgaagtcgaacaacccgctgggcatcgacatgaaggggccgcaggattccatcccgttccatcccttctacaccatcaaggacctgtacggcatcggcctgttcctgatgttctacctggccttcgtgttctgggcgcccaacttcttcggcgagccggacaactacatccccgccaacccgatggtgaccccgccgcacatcgtgcccgaatggtactacctgccgttctacgcgatcctgcgcgccttcaccttcgacctgcccttcctgccggccaagctgcagggcgtgctggccatgttctcggccatcctgatcctgttcgccctgccctggcttgacacctccaaggtgcgctcggccaagttccgtcccctgtaccgtcagttcttctggctgttcttcgcgaacgccatgatcctgggctacgtgggcggcaagccggccgaaggcatcctggtcaagatcgggcagttctgcaccgcctattacttcgcccacttcctgctgatcctgccgatcctcggcaagatcgagaagcccaaggccctgcccgcctccatcgcccagccggtggtcaaggccgccgccctgatcgccatgatcatggtggggctggccggcttcggcggcgaggcccaggccagcagcgccggccccgagttgaagaagccggccgtcgccttctcctgggaaggcttcttcggcaagcacgacaaggcggcgctgaagcgtggctggcaggtgtttcatgacgtgtgctccaactgccactccatgaagctggtcgcctatcgcagcctgaccgacatcggcttcaccgccgacgaggtcaaggccttcgcggccgagaaggaagtgcccgaccagcccaacgacgaaggcgtggtggccaaccgccccgcccgtccgtcggacaagatcgtgccgcccttcgccaacgacaaggccgccgcggcggccaacggcggcgccctgccgcccgacctgtcgctgatgaacaaggcccgcaccaacggtccctactatgtctactcgctgatgctgggctatgaagaggctgctcccgagggtcatccgatccccgagggcaagtacttcaaccactacttccccggcaacgccatcagcatgccggcgccgatcatggacgacatcgtcgcctatgccgacggcaccaaggcgaccaaggagcaggtggcctacgacgtcgtgaccttcctcaactgggccgccgagcccgagttggacgcccgcaagtccatgggcgtcaaggtgatggtgttcctggccctgctcaccgccatgctgtacgcgctgaagcgtcagatctggaaggatgtgcactgaggccgggcccgcgccttaagtcacaccaaagcctgtgaggcggccgtcgttggcaacaacggcggccgtttcgttctgttcgcccctcgccgggcgcgcgcccccggcgcgcttggccgcggccgcaatggccgccgtttcgtttggatggcgccttgcgccgtgatatggtccgcccgctaatgccggcaggggtcgtcaatccgttgagcaagcagaagatttcattcgatcattccacctgggttctggtgcgccgcctgttcaacgagggcatgcgcccctacatgggcaaggtgatggccgccgtgttctgcatggtggtcggcgccgccgccaatgcgggctatgcgctgctgatggacccggtggtcaacaagatcttcacggaaaagcggccggaattcctgctgcccctggcgctggcggtgctgggcacctttgccgtcaagtcagtgtgcaattacggcgaggcggtgttcctgtccaaggtcggcctgcgcgtcatcgccgacatgcagtcgcgcctgttcgcccacctgatgcgcctggatgtggccttcttccatgccaattccacgggccgcatcctgtcgcgcctgaccaacgacatttcccagatgcgctttgccgtgtccgacgccctgaccggcgccggcaaggacgcctcgtcggtgatcttcctgatcggcgccatgttctatcaggactggcgcctgtcggcctggaccttcttcattttccccatcgccatcctgcccatccgcaagctgggccggcgcatgcgcaaggtgaccgccaacacccaggagcacatgggccagttgaccacctatctggaacaggcggtccagggcatccgggtggtcaaggcctatggcatggaggaatacgagaagcgcaaggtcggcgccctggtggagatgctgcaggacctgatctacaaggcggcccgggtgcgctcggcctcctcgcccatcatggaattgctgggcggtatcgccatcaccgtggtgatcctgtatggcggcacgcgggtggtgaacggcgagaccacgcccggcgccttcttctcgttcatcaccgccctgatgctggcctaccgccccatcaagtccctggccgccatgaacaccaacctgcaggaaggcctggcggcggcatcgcgcaccttctcggtgctcgacacccagccgaccatcttcgagaaggacggcgccgccgatctggtggtgctggagggcaatgtcagcttcgagggcgtgttcttcacctatgacggcagcaaggcggtgctggacggaatcgacctcgccgtgcccggcggcaagaccgtggccctggtcgggccttcgggcgccggcaagtcgacggtgctgaacctgctgccgcgcttctacgacgtcaccgacggccatgtgctggtggacggccaggacgtgcgcaacgtcagcctttcctcgctgcggtccaagatcgccctggtcagccaggaaatcaccctgttcgacgattccatccgcgccaacatcgcctatggccgcttcggcgccaccgacgaggagatcgaggctgccgcccgttccgccgccgcccacgacttcatcgtcagtctgcccgaaggctacgacaccgtggtgggcgagcgcggactgaacctgtcgggcggccagcgccaacgcctggccatcgcgcgggccatgctgaagaacgcccccatcctgctgctggacgaagccaccagcgcgctggacaccgaatccgagcgccaggtccagaccgccctggaactgctgatgaggggccgcaccaccatcgtcatcgcccaccgcctgtccacggtggtcaacgccgacctgatccacgtgctggacaagggccgcgtcatcgaatccggcgaccacaacgcgctgatggccaagaacggcacctacgcccgtctctacgccatgcagttcgccgaggaagccgtcaaggccggcagcggaggctaaagcccatgggcctggccaagcgcatcggcaagagcgaatggctgcgcggcgccctgtgctggctgggttccctctatatccgcctcgtccatctcaccggacgctggagcgtggtcaatggcggccatgcccaggcgctgtgggatcagggcaagcccttcattctggccttctggcacggccgtatcctgatgatgcctaagtcctggcgccaaagcgttcccatccacatgctgatcagccagcatcgcgacggccagctgatcgcccgcacagtctcgcatttcggcatcgagacggtgcagggctcgaccacgcggggtggcagcgcggcgctgcgggccatgctgaaattcctcaaatccggcgaatgcgtcggcatcacccccgatggccccaagggaccgcgcatgcgcgcctcggacggcatcgtggcggtggcccggctggccggggtccctatcctgcccgccacctttgccaccagccgccggacattgctgggcagctgggaccgctttgccgtggcccagccgttctcacggggggtcttcgtctggggcgaccccattctggtcgccaaggatgccgacgaggccgccatggaagcggcccgccgggcggtggaagacagcctcaacgccatcacccgggacgccgatgcccgcgtgggccagacctcgcccgagccggctgcggctgagggggcgccatgatctatcgcctctaccggggactgaccaccctgggcggcccgctgatcgccgcctatctggagcggcgcaaggcgcggggcaaggaagacggcacccgctttcccgaacgtctggggcatcctggaaccgcccgccccgccgggccgctggtgtggatgcacggcgcctcggtgggcgaggccctgtccatgctgcccctggtggagcgcctgctcggccggggcctgtcggtgctgatgaccaccggcaccgtgacctcggcccgcctgctggccgagcgcctgccccggggcgccgtgcaccagtacgtcccagtggaccgcatcgcctatgtgcgggccttcctcaatcattggcggcccgatctcgccctgtgggccgaatccgaattctggcccaacctgctggccgagacccgccatcgcggcatcccccaggtgctgatccagggccgcatgtcgccccggtccttcgccgcctggaagaaggtccccggcttcatccacaagatgctgtcgggtttcgccctgtgtctggcccagaccgaatccgacgccggacggctgcgggccctgggggggcgcgacgtgcgctgcctgggcaacctcaaatacgcggtggcaccgctgccctgcgatcccgtggccctggacgggatcaaggccagtatcgccggacggcccctgtggctggcggccagcacccatccgggggaagaggccctggccgggcgggttcacgccgccctcggcatggccgacctgctgaccgtcatcgtgccgcgccatcacacccgcggcgccgaggtggcggcggagcttcgcggccagggactgagcgtcgccctgcgctcggcgggcgaggcgatcacgccgcaaaccgcaatctacatcgccgacaccatgggcgagctggggctgttctaccgcctgggcggtccggtcttcgtcggcaagagcctgaccatcggcggcgggcagaaccccttcgagccggcgctgctgggcgccgccgtgctgttcggcccgctgatggacaacttccccgacatggcgccctccatgctgtcggcccaggccgccttgcgggtcaaggacgagggcgaactggccatgacggtccgcgccctgctggccgatcagcaggccctgcgggcggcgggccaagccgccaaggtctgggccgagggcgaggctggcgtgctcgatcaggtggacggcgccctggcgccgttcctcgcgcccctggaggcggcccatgcgcgcccctgacttctggcgcaaggacaatgccgtctcgcgcctgctggcgccgctgggagcaatctatggctgggcggtgcgccgcaacctggagcgggccgaggaataccgccccgccgtgccggtaatctgcgtcggcaatatcgtggtgggcggagccggcaagaccccggtgggcatcgccctggcccgccgcttgatcgccgccggggtgaagccccacttcctgacccggggctatggcggcaccgaggtcggcccccgcgccgtggacctggaccgccacgacttcgcccgggtgggcgacgaggccctgctgctggcccgcgaggctcccacctgggtgtcgcgctggcgccccgacggcgcggtggccgccaccgagatgggggccgaggtcatcatcatggatgacggcttccagaacggctccatcgccaaggacctgtcgctggtggtggtggatggcagctacggcttcggcaacggccgcaccatgccggccgggccgtgccgcgaaccgccggaccaggggctggcccgcgccgacgccatggtggtgatcggcaaggaccgccggggcctggctgagctggcccgcgcccacggcatccccctgctggccgcccgtctggtccccggccccgagggcgccgacctgaagggccgcaaggtggtggccttcgccggcatcggccgtccggaaaagttcttcgcctccctgaagcaatgcggggcgcggctgaccgccgaccattcctttcccgaccaccaccctttcacccgcgccgatatcgaggccctgctggccgaggccgaggccaacgaggccctgctgatcaccaccgccaaggaccgggtccggctgcccgccgacctgcgcgcccgcgtggcggtgctgagcgtatcgctggactgggacgccccctctctgctaactcccctgttcgaccggatcggagtgagggcatgacgaggaaggaactgcgccagcgcctggaagccctgggggcccgcgccgtctgggcgctgttcgccgccctgcccgtggacgccgcgtcgggtctgggaggctggctggggcggagcgtcggtccgctgctgggcggcgtcaaccgcatcgcccgcaagaatctcaaagccgccttcccggagaagagcgaggccgagatcacggtcatcatccgcggcatgtgggacaatatcggccgagtggccggcgaattcccccatttggacaagatcgccaacgagcgggtggaactggtcggggcggaatacatcgacctgctgcgcgacgacggacagccgggcatcttcatttccggccatgtgggcaattgggagatcaatggcgccgtggcggcgctgcgcggcctgccgctgcatctggtctaccgcgccgccaataatccccatgtggaggatctctaccgcaaggggcgggccagcatctccaccaccatgatccagaaggggccggaaggcgcccgccaggcgctgatggtgctgaagaagggcggccatctcggcatgctggtggaccagaagatgaatgacggcgtgccggtcccctttttcggccgcgacgccatgaccgcaccggcccaggcggcattcgccaccaggttcaaatgcccgctggttccggcccgggtggagaggatcggcggcgcccatttccgggtcacggtcctgccccccatggactttccccataccaacgacaatcacgaggacaaccgcctgctgctggtccgcatcaacgccctgctggaagagtggattcgcgagcggcccgaccagtggctgtgggtccaccggcgctggccggaatgagcagcggcttcaccgcctatctggccgctcccggcttcgaggccgacctgcgggttgagctgggcgagatcagcgccgaatacggccgcctgatgctgtcgcccggcccggccaagcccgccgcctgggcccagaacatctggctggcgccccaggtactggaggtggcctccatcggcgaggcggccaaggccctgaaggccatccagcgcaactggtggccctatgagttccacctgcaccgccgcaccgccctgctggtggacaagctgcccaaggtctcggccaagccgatcccgttcggcaccccggcgcccaccgcgccgctgggcgccttcacctggatggacgaaggtcatgtgctggcctcggcccagtgctccagccccttccccaatggcgagccggtcttcgtcgaggaccgcgtcaccccgcccagccgcgcctatctcaagctgtgggaagcgctgaccctggcgggcgagatgcccgggccgggccagacctgcgtcgatctcggcgcctgtccggggggatggacctgggtgctggcctccaccggcgcccgggtgatcagcgtcgacaaggcccccctggcccccaatgtggccgccatgcccaatgtggaggtccgccagggcagcgccttcggcatcgagccctccgagatcggcccggtggactggctgtgctcggacgtcatctgctacccggagcgcctgctgcggctggtggagcgctggatcaaggccggtctggcgcgcaatttcatctgcaccctcaaattccagggcgagaccgatcaccagacggcccgcgcctttgccgccattcccggctcgcggctgctgcatctgagccacaacaagcacgagttgacctggatgcgacttgccaccctatgcccttgggagtaaaccagtagcttcggggaacatttgccaggacctatcgcctcatgtccgtcgccaagcttccgccgccggtggaaatcgataccgagaccaaaaagggcgtcatcgagggcctgaagagggtgctgggcaccttccagcaggccggtctggtggatgcggccgtcacctatcagcaggtgatttcggaccccgacgtgctgcaatccttcatcaagaccttccagaccagccgtgagctggtggacgacatcgtccgggccagggactccgacgatccggtgcgcgacgaaagcacgaccctggtgtgcggcgtcagcctggggcagattcagcaattgctggtccgcacctgcgccaagaagatcttcgaggccgacaagcccatggagaccatcaccgagaccgtgaccaaaagctccatgttcggcctgatcaagaagaccgagcagatcgagcggcaggccgtggacccggtggaggagcgcaagattcgcgagctgtcgcgctatatcgccttcggctggcaattgccgctgcttgagacctaccgcaccaacctgtcctatccccagatcatcgagatcggcgaggacatcgtcgccctgcccaccgccgcccatatcgtcgcggtgtccaagttcgagccggacaagctgaagaaggtcaaggccgccgtgggcggcgagttcggcgccattctcgccgaccgcccccaggccatcggcggcatctcggtgtggaaccgggacatgtacgagttctatcacaagatgctgggccagaaggcgtgggagttcttcgcccgcgaaccggccttcttcaatgtctgtgccgcgctcgacaagtcggtgtcgcggatcttcggcgacatgctgtgctatatcgccgccgagaacctgcaggagatccagcgcctcaacatcgacaaggtcgaggtgatggtgcatgcgctgaagaccggattcggcccgcgcaccccggaaatcctggccattcccgccttcgccaaggacatactgcgcaaggtggtggacaacctgctgcacatgacccaggagaaggacaagctgatgctggccttcgggctgtccatcaaggccatggtcccggccgtggacgagtggctggccaagcggcattgatgacggccgtccgttgacatgaccggccagggcctcatcggcatcatcgccctgatcggcgtggccttcctgctgtccgaggatcgccgagcggtgtcgtggcgggtggtggtggccgggctggccgtgcaggggctgctggccctgctgctgctcaaggtccccgccgccaagctgctgttcctgggcctcgaccgggcggtggcggcgcttcagaccgccacccgggccggcacctccttcgtcttcggctatgtgggcggcgcccccgccccctggaccgcggccaaccctgcgtccggcttcatcctggccttccaggccctgcccctggtgctgctgatgagcgcgctgtcagcactgctttatcactggcgcatcctgcccgtggtggtgcgcgccgcctcgcgcctgctggaaaagtccatgggtgtgggcggcgcggtgggggtctcggcctcggccaccgcctttctgggcatgatcgaggcgccgctgctgatccgcccttatgtgggcaagctgtcgcggggcgagctgttcctggtgatgacggcgggcatgtccaccatcgccggcaccgtgatggtgctctacgccaccttcctggacggaatcatccccgacgccatcggccatctgctcactgcctcgctgatctcggtgcccgccggactgatgatcggcaagatcatggtgccagattgcgcgctgactggcgctggcaagctgggggacggacatgattacgccggctccatggatgcggtggtgaaaggcaccatggacggcgtccgcctgctggtgggcatcgtcgccatgctggtggtcctggtcgccctggtcagtctggccaatgccggcctcgccctgctgcccgaggtggcgggggcgccgctgaccctgcagcgggtcttgggctgggccatggccccggtggtctgggccatgggcattccggcgggcgagatggtcaccgccggcgccctgatgggcaccaagacggtgctgaacgagctgctggcctacctcgacctggcccacctgccgcccgaagccctgtcggcgcggtcgcggctgatcatgacctatggtctgtgcggcttcgccaatctgggctcgctcggcatcctgatcgccgggctgtcggtgatggcgcccgaacgccgggcggagatcgtcgccctgggcgggcgctcaattatttcgggaactatggcaagctgccttaccggcagcatggtcggacttctactgtgatcgtcgccggctgcggcattcgcagcatgtttacaataggccccggatgttgcatggtcattgcatcatgagttcgggcgccgatcacttgcgactactgattatcgaagacaaccctggcgatcagcggttgatcgaaatcgaattggctgacgcccagcccagttggaaagtctcgtgccgctcaaccttgggcgaggccttgaaggacgctccgtttaacgctttcgactgcgttctttccgaccttggccttcccgatgcttcgggcatcgaatccgtgctgcggctgaaatcctgggcgccggacaaggcgctggtggtgctgaccagcctggacgacgagcgggtggcccaggaagccatccgggccggcgcccaggattacgtggtcaagtccgatgccggcctgaccctgctgccccgcgtcatccgccacgccatcgagcgccagcaggcccagacggaactggaggcctcgcaccgcacctcccaggccctgctggacgccagccacgacatcgccatgctgctggacgccgagggccacatcctgacgctcaacaccgaggcggagcagtacctgaacgcctcacccgacgcggtgattggccaaagcatcttcgacctgctgcccgaggccctggccgaacatcgccgctcgttcctggccgaggccctggacagcgggcgcaccgtccagttcgaggataccgacggcatccactggttcgccaaccgcctgctggcggtggccggcatggaactgggcgagcaccgcttcgccatgttctcccgcgacatcacgggagagcgcgccgccgccgccaccctggccgaggccaaggaagaggccgatttcgccaatcgcgccaagaccgaattcatgggccgcatgagccgcgatatccgcacgccgctcaacgacgtgatcggtttcgccgaaatgatctccaccgagatgctggggccgctgacccaggccggctaccgagaatacgccgattccatcctcaattccggcagccagatcctgaagctgctggaccgcatcaccgacgtttccatgctggaatcggcgctgctcaaggatcaggcgtcctatcgcgatctggtggagctgtctcccgatctgatctgcgtctgtgtcgacggcgtcatcgagcgcatcaacgccgccggcctcggcatgctgcgcgccccctcggccaccgcctgcgagggcaagcatttctccgagttcatccatcccgactaccgcgccattttcgagggcggcctggacaccttgtacgaagaaggccatccgttgccggtcaaggtggtgaccttcgccggtcgggtgcgcgacgtggagctgtcggcggtgccgctgcggcgcgaggcccagaacgccaccctgctggtgggccgcgacaccaccgaggtgaccgccgccatgcgggcggtggccgcgcgcgagcaccgcatccgcgccatcatggacaccgttctcgacggcatcgtcaccatcgacgaggacggcaccatcctcaacgccaatctgtcggtggagcgcatcttcggacactccctgtcggaactgatcggcgccaatgtctcggtgctgatgcccgagcccgatgccggccggcacaacggctatatcaagaactatctgggcaccggcatcggcgccatcatcggcgtcgggcgcgaggtgatgggcaagcgcaaggacggatcgctgtttccggtccacctgtccatctcggaactgcgcgtggaaaagcgccgcatgttcaccggcaccatccgcgacctgaccgagaacaagcaactggcccagcgcgtggcctatctggccaatcacgacccgctgaccgacctgcccaaccgcaccttgctgaccgaccggctgggccaggccgtcgccatggcccgcaatgccggactgcacgtggccatcatcaccgtcgacctggacggctttaccaccatcaacgattccatgggccacgacgtgggcaattccctgctgcgcgagacggcacggcgtctggcccaggcggtgggttcgggcgggaccgccgcccggctggccggcgacgagttcgccgtggtggttccccaggtccacgaaatggacgaggtgacccggcaggtcgaccacatccacgacattctcatcaagccctacaccatccacggcaccgagatggtggtgccggtggacatgggcgtctcggtcttcccgcgcgacggcgacgatgccctggaattgctgcgcaacgccgagatggcgctgcacaacgtcaagcgccgcagcgaccagcgcatgggctatttcgacgccgccatgtccttcgccgtgaccgagcgcatgacgctggagcgctccatcaaggatgcgctgcgcgccggccagttcgagctgttctaccagccccaggtccggctggccgattacgccctggtgggggccgaggcgctgatccgctggcgccatcccgaactgggcatcatcaccccggacaagttcatcccagtggccgaggaaaccggcctgatcgttcccatgggaagctgggttctgcgtcaggcttgcacccagttgcgcctgtggaacgatgccggcatcgccaatttgcgcctgggggtcaacatttccggccgccagttccgcgaggccgagccgactgcatttccgaaaccggggtcaacgccaaggacctggacctggaactgacggaaagcatgctgatggccgatggcgagggcacgctgaagctgctgcgctcgctggccaagctgggcgtgacgctgtccatcgacgatttcggcaccggctattcctcgctggcctatctcaagcggttcccggtggacaccgtgaagatcgaccgcgccttcgtgcgtgacctggaccaggacgaggatgggcgcgtgctggtcaacgccatcatctccctggcccattccctgtcgctgaagaccatcgccgagggcgtcgagaccgaatcccaggccgcattgctggcccgccatggctgcgacgagattcagggatacatgatcgggcgacccatggcggtcgccgatttcgccaacttcgccaaaagctactgtccccgcaccccggagaaggttaccgtgctgcgggcggggcagagttgaatgtctgagaggatcgggacatgaccggtaccgtcgtcgtcgttgaagacaacgcgatgaacatgaagctcctggaacaggcgctgaccatcgcgggctataccaccgtcaagtcgtcggatggagatggcctggtcgacctgaccgccggcagcggggccggcgtcattctcatggacattcagctgcccaaatattctggcatcgacctgctgaagcagctgcgggccgacgaccgcaccaagggcgtgccggtggtggcggtgaccgccttcgccgaccccgattccgtggccggcttcctggaagagggcttcaatcaggtcatcaccaagcccatctccatccgcaagctgctggatgaagtggcgcggtattgcggcgggcaataagcccgcagcgatcccatacgcgtcgggacagggcgccgttcggccgctactgcgcggtgaattgcttttccacgtccttgatcaggtcgatgccctgaatcatctcgctcatcatgaagtcggcgcgcttgatgggaccgcccgaattggggcgggggaacatcttggcgaacgagctcatcttcacggtcaggccgcacagggcggcgccgatggtgacgtgatagcgctcgatcatgcccttcaccgagcggaattcgtcctgtgagatgttctcccacatctcgcgggtccgcttgtcgaacacctccagccgaccggaaatggaggcggagatcgagttgatcacctcctcgatcatgtcgcaggtcttcatgaggttgacgttctgcttcagctggaaatgggtgcggatgggcgacagcgcctggacgcaggcggtgaaatagggctccagccggtcgaggcagtgacggaaatacgacagcgacatgaaggtgtcgccgtaatcctcgagaaagcgcggcacgtcgaagatgtcgatattcaggctttgagccatggtttccaggcgctggcgcgccttcttgatatcgggatcgcggaacagcttcagcaggtcgtcatagctgtcgatatgcacgtcctcgcccgaatagatcatcttcatcagcgggcgggtgaacatgatcatgtagcgggtcagctccgccgccttttccggcgacagcttcaaggccgcgtagtcgttcaccggaatgccgtgctcgcgcaagctgatgcgcaaggagtagacgtcgtagctgggcagcagcgccagacggcgcaggatgccgaggtcggggtgaatctgttccgtcggccagccgaacatggcgggcagggattccacgtccacctggcccgagccggtctggacgtcggaaaacagctcgaccgcgctgcgcagccgcacgttcttgatcagcttggcgctttgcaaggccggggtctggagcgggataatcgacagcggcagcacgaacatggaatccatgtcgctgtcattgataggcttcaatccatcgtcgtcagtcatgatactctcggtccccaacccgagggcacattgtgcctgctttgccgccgatcgcaatggggaacattgctttgaatccgcctgaatgcatcacttacatgaggatttcatgatatttgtcgtgtatcctctgcccgtgatgcgtcgtttccgtggggggaaagctgccgtgcctgccagaatgcctatccggtccatcgtgattgcggccttgctgctgctcctgaccaccggcctggggctggcccaggacatccgctttttccagatcggcaccggcccgacgggggaaacccgcttcgccttcggcggtctgatcgccaatgccatcagcaaccctcccggctcgcgcgagtgcgacaaggggggatcgtgcggcgtgcccggcatggtggcggtggccaagtccaccggcggcgccatcgccaatatcgacgccatcgccgccaagcgcctcgacgccgccctggttcagtccgacatcgcctattgggcctatcacggcaccggcatctacaagggcaagggggcggtgcagaatctgcgggccatcgccatgctgtatccggaaagcctgcatctggtcgcccgcaaggatgccaagatccactcggtcaaggacctcaagggcaagcgggtctcgctgggcgacaaggattcgggcgaactggtgcacggccggctgctgctggccgccttcggcatgacggaaagccagatcaagcagagcttcctgaagcccggccccgccgccgacgccgtcgccgccggccagctggacgccatgctggtggtggatgggctgccggtgcccatcgtcagcgagctggcccagcgctccgacatcgtgctgatccccctggccgggccggaagtggacaagatgcgggcgacctatcccttcttcgccgcctcgtccattcccgccgacacctatcgcggcagcgatgccgaggtgaagaccctggacgtgggcgtggtgctggtcaccggggccgagcagcccaacgacctgatctatggcgtcacccgcgccctgtggcatcccagcacccagaagctgctgaccgaaagccacccccgcggcaagctggtcagcctgtcggccgccggcctggacaagctgggcatccaactgcacggcggcgcctcggcctattatttcgacgcgggcgtgacgcactgaggcatatatcgggctatcgcccgagcccatccggggcgatgccccgaaccccatttgatttcatcgaggggtttggggcccatggccccaggcgggggtgggcggcagcccacagcgcctctggcatgaattgaaaggccgtactatcttggcccccatgagcgacacccccgcccccacgccctatcgcgtcctggcccgcaagtaccggccgaccgacttcgccggtctgatcgggcaggaggccatggtgcgcaccctgtccaacgccatcaagaccgggcggctggcccatgccttcgtgctgaccggcgtgcgcggcgtgggcaagaccaccaccgcccgcatcatcgcccgcgccctgaactgcgtcggcctggacggcaagggtgggccgaccatcgatccctgcggccagtgcgagcattgccgcgccatcgccgaggaccgccacgtcgacatcctggagatggacgccgccagccgcaccggcgtcaacgacatccgcgagatcatcgagggcgtgcgctatcgccccacctcggcccgcttcaagatctacatcatcgacgaggtccacatgctgtccacggcggcgttcaacgcgctgctgaagacgctggaggaaccgcccgagcacgtgaagttcgtgttcgccaccaccgagatccgcaagatccccgtgaccgtgctgtcgcgctgccagcgcttcgacctgcgccgggtggagatggaggtgctggccaagcacttcgaatccatcgccgccaaggaacaggccgaaatcgagccggcggcgctcaagctgatcgcccgggccgccgacggttcggtgcgcgacgggctgtccctgctggatcaggccatcagccatggcgccggagcggtgaccgaggcccaggtgcgcgacatgctggggctggccgaccgcgcccgggtcttcgacctgctggacgccatcatgaaggggcaggttcccgccgccctggaccagatcaccgaccaatacgccgccggcgccgatccggtggtggtgctgcaggacatgctggaactggtgcactggctgacccggctcaaggtcactcccgacgccgccgaccagttgggcgcctcggagaccgagcgggtcaagggcgccgagatgtccaagaccctgtccctggccgcgctcacccgcgcctggcagatgctgctgaagggcttgggcgagacccgcaacgcccccaacccgctgcaggccgccgagatggcggtggtccgcctggcctatgccgccgaactgcccagtccggccgagctggtcgagcaattgcgcgccaatccccccccgccccccgccccgcgcggccccggcggaggaggtagcggtggcggctttggcggcggcggtgccgacgcggtctccaatcatcatatgggcggcggcccggtgcacggccccgccaccgccctgaagcttcagcccgcccccgtggccgagaccgtgaccctacccgccatgccccccgacttcgcggcggtggtggcgctgttcaccgaacgccgcgaaggcctgatcgccgtccaactgcggacacaggtcaatctggtgtccttcgccgccgggcgcatcgagtggcgccagaacagcggcgtcggctcggatctggcgcccaagacggcgcgcctgctgtcggaatggaccgggcggcgctggacggtctcggtcaattccaccgattccgcccagccaaccctggccgagcaggaggccaacgccgagctgcgccgccgcgccgacgccgccgaacttccgctggtcaaggcggtgctggccgcctttcccggcgccaccatcgaggcggtgcgcgatctcggcgccgaggaattgcccgatgccccgccgcccgaggacccggaggcgatgctggacgacgaaatgctccctggagaggaagacctatgaagaaccttggcaacctgatgaagcaggcccagcagatgcagtccaagatggccgagatgcaggccaccatggccgagatggaggtcaccggctcgtccggggccggcatgctgcaggtgacgctgaacggcaaatacgagttgaagaaggtcaagatcgacccgtccctggtcgatcccagcgacgtggaagtgctggaagacctgatcctggccgccttcaacgacgccaaggccaaggccgaggccgccatggccgaggagatggccaagatgaccggcgggctgaacctgccccccggcttcaagctgccgttctgatcccggtatagttccgcccccgcaatggtcggccccgagatcgagcgcctgatacaactcctttcgcggttgcccgggctggggccgcgctcggcccggcgcgccgcgctgcgcctggtggaaaagcgggaaagcctgctggtcccgctcgcccaggccatggccgacgccgccgccagggtgcgcacctgctcggtctgcggcaatttcgacaccatcgatccttgcgccatctgcgccgatcaccggcgcgatccctccatgctctgcgtggtcgaggacgtggccgggctgtgggccatggagcgcaccggcagcttcaaggggcgctacgccgtcctcggcggcctgctctcggccctggatggcgtcgggccggaggatctgggcatcgagtccctggtggcccgcgccctcgatcccgccatcaccgagatcatcctggccacccccgccacggtggagggccagaccaccgcccattacgtggccgagcgcctggccccgtgcaacgtcaccgtctcgggcctcgcccatggcgtgccggtgggcggcgagctggaccatctggacgacggcaccatcaccgccgcgctgcgggcccggcgggtgttctgagcccatccggccctatttgacaggctgcggcaaggctccgcttcgggggcttttgcccccgatcccccaatcgggaagcacagcttcccgaacccttcagctttttaaaaactggtggctcggaggctgtgcctccgaacgggcctgggcggcagccccgccgcgaagcggagtttctccccagcctaccccgcgatcctggcttccatgacccaggcctgcagggcgggatgggccatgatggcgtcgcaataggcgccggccaccggccccaccggcaggttgtaggtgcggatgcgggtgaccaccggggcatacatggcgtcggcattggtgaaggcgccgaacaggtagggtccgccctggccgaagcgggtgcggcactcggtccacagcgcgtcgacgcgcgccacgtcggccttcacgtcgtcgggaatctcggccatgggatggtcttccaccacatccatggggcaggtggagcgcaacggcacgaaaccggcatgcatctcggccgagaccgagcgggccagggcgcgggcctcgcgatcgtccggccacagcttggccccggggaaacgctcggccagatattcgcagatggccagagaatcccagaccttgatgccgtcatcgtccagcatggggatcttgcccgagggcgaccattcgagaatcctggccttggtctcgggctggcgcagttcgatgaacacctgacggaagggcgcaccggtcaccgccagagccatccaggcccgcagcgaccacgaggaccaacgcttggtgccgacgacgagggtgagagacatgacgcttcccaaacggtggatggtcaccgatcatgggagcaagcgcggggcgtcatcaatagggaattcaggaggaacgggtgctggagcaactggtcgaggccgacgacaacgccacgaatctgaccgtcctgcgcaagggcgacctggacggctggctggcgggccagcccccgtccgtgcgccaatgggtcgagcagaccggctttcgggccgaacccggcgccgtctgcctgttgcccggcgaaggcggcgccctgggcggcgccctggcgggcctgcctgacgaggccgatccctgggccttcgcccattttccgtccaagctgcccgcccgcacctggcggctggccatgccgctgcccgccgcccaggcgggacaggccgccctggcctgggcgctggccgcctatggcttcgaccgctacaaggcgcgcaagggcaaggacctgccccgcctggcatggcccgagaccgccgaccgcgcccgggtggagcgcgaggtcgaggccatctcgctggtccgcgacctgatcaacacccccgccgccgacatggggccggcggaactgtccgccgccgccgatgccctggccgcccgcttcggcgcgaaatgccgggtgatcgtcggcgacgggctgctggccgagaactaccccgccattcacgctgtgggccgcgccgccgctcaaagccgccgcccccgcctgatcgacctgcgctggggcgacgaggcggcccccaaggtcaccctggtgggcaagggcgtctgcttcgataccggcgggctggacctgaagccgtcgtccaacatgaagctgatgaagaaggacatgggcggcgccgcccatgtgctgggcctggcctccatgatcatggccgcagggctgaagctgcggctgcgcgtgctgatcccggcggtggagaactcggtgtcgggggaatccatgcggccgctggacgtgctggccacccgcaagggcctgaccgtcgaggtgggcaacaccgacgccgagggccgcctgatcctgtgcgacgccctggccgaggcctcggccgagaagcccgccctgctgatcgacgtggcaacgctgaccggggcggcccgcagcgcgctgggcaccgacctgcccgccctgttcagcaacgatgaccggctggccgccgacatcctggaagcgggagaggccgcgggcgagccactgtggcgcctgcccctgcacaaaccctatcgccggatgatcgattccaaggtggccgacctgaccaacgcctcggattccccccatgccggcgccatcaccgccgccctgttcctgcaggaattcatcgagcccggcaccccctgggctcacttggacatcatggcgtggaacggcgccggacggcccggacggcccgagggcggcgaggccttggcactgcgcgcgctgttcgccaccatcgcccggcgggttgacggttaacacagggctttacaggggccaagaatccttccatgagtcttccctatccaaggggacagatgacttgatcgactttaggccggttctcttcgtcaacggcttcctgctgctggtgctggctttggccatgggcattccggccatggtcgacttgtcggcaggcgacgaggattggaaggtgttcgcggtgtccgccatggtcaccgccttcgccgccctgtctctgatcttcggcacccgggccaagggacgcccgaccctgtcggcgcgccaggccttcatgctgaccacgctggcctggatcagcacggcggcattcgccgcgctgcccttcgccttcggcaacctccacctcagccccaccgacgcggtgttcgaggccatgagcgggctgaccaccaccggggccacggtgatcatcggcctcgaccatgcgccccgcggcatcctgatctggcgggcgctgctcaactggctgggcggcgagggcatcatcatcatggccatcgccatcctgcccctgctgcgcatcggcggcatgcaggtcttccgtatggagacctcggacaagaccgagaccattaagccgcgcatcacccaggtggccacctccatcaccctggtctacgtggtgttcactgtgctggcggccctggccttctgggcggcgggcatggggcgcttcgacgccgtctgccacgccatggccgccatttccaccgggggcttctccacctcggacaccaagctggcccattggaacaccgccgtgcaatgggtggcggtgttcgccatgatggtgggaggctcgtccttcgtgctgtggaccggcccctggcggcgcgggcgtccgcgcatcgtcgacgacgcccaggcccactggtacctgatgttcatcggcaccgccgccggcgtggtggcgctgtggcaatgggcggtcaacgacatgagcctgggcgtggccgtgcgacacgccaccttcaacgtggtctccaccgtgaccagcaccggcttcgtctccaccgattacggcacctggggcggctttgcccatgtggtgttcttcatcctggtgttcatcggcggctgtaccggctccaccgccggcggcgtcaagatcttccgctgggaattgctgttcgccctggccggcattcacctcaagcggctgctgcacccccacggcatcttcgtcattcactacaaccaacgccccatcgccccgtccgttctggattcggtgcagggcttcgtggtgatgtacttcttcaccttcgccctgttcgccctgggcttgagcgtggtgggcgtcgacttcatgacggcgctgtcgggttcggccgccgccctcgctaatgccgggccggggatcggcgaggtcatcggccccttcggcagctatcgccccctacccgacgcggccaagtggattctcgccgtggaaatgatgctgggccgcctggaactgttcaccgtcgcggtgctgttctcgcgcagctattggcgggagtgacggccagatgatcgaccttcgccccgtcctgtccatcgtcggcgccctggtctgcatcctggccgccgccatgtggctgccggccgccatcgactttcgcgacggacacgaagagtggcgggttttcgccacctcgtcgggattgaccctgttcttcggcctggcgctgctgctgggcacccgcctcccgcagcagcggcgcagcgtccgccagacctatctcgccgccaccttcgggctcgcggtgccggccctgttcgctgcgctgcccctggtctacggcccgttgcaattatcgttcgtcgacgcagccttcgaggccacggcaggactgaccacctccagcgccacggtaattcgcggcctggacgtcctgccgcgcggcctgctgctgtggcgggcgctgctgggctggctgggcggcatcggcgtgatcgccctcgccatcgccgttttgcccgacctggcggtgggcggcatgcagatgttccgcgtggaagtacccggccccgccgaacgcgccacctcgcgggggaggcgcatcgcggcgtccatcctggccggatattgcggcgcgacgggattgctggccctggccctgtggctggcgggcatgagcggattcgaggcgctggtccacgccatgggcaccatttccacctcgggcgcgtcgacctcggacgcctccatcggccatttcgacagcggtgccattaccgtgctgatcaccttcggcatggtgctgggcggcatgcccttcctgctgttcttccatttcctgcgcggcaaccgcaaggtcgtgctgcgcgatcaccaactgcgctggtatttcgccctgctgaccctgggtaccctgggggtgtcggcgtggctggtgagctcgcgggggctggcgccgctggacgcgctgcgccatggtgcgctgaccgtggtgtcggtgatgaccggaacgggccatttcaccctggaatacggcaattggggcggcatgcccgccgccattctgttcttcctggccttcgtgggaggctgtgccggctcgaccagcggcggcatcaaggtcttccgcttccagttcctgttcgccgacgccctgatgcagatccgccgcctgctgcgcccgcacgccgtgctgatcgccaccttcaaccgacggcccattcccgaaggggtgctgggctcggtgatgggcttcctgttcgtctacgcgctgagcttcgccatgctgtccatgtccctggctttcctggggctggacttcgtcaccgccgtgtcgggggcggcctcggccctggccaatctggggccgggcctggggccggagatcggccccggcggctcctatgccggcctgcccgatctggccaagggcctgctctgcctgggcatgctggtggggcgactggaactcttcaccgtgctggtgctgttcgtgccagcgttctggcggcagtagccgctgggccgaagaggctcagccgaacagcttgtcgatggcgtcctggcccagcatgcggtcgacatcggcctggctgacgccctggccgggcagctgcgggccgtgcagcagggccttgtcgggatcgacctcttccttcttgatctcgacgaccaccttggtcagctcgtccttgccccaggtgaggatgaccgccttgatccggtcctcgacgaatttcagggaattgacgatcttggagatgcgctggccggtgatgtcctggaacgagcaggcctcgaacacctgattgacccggtcctccaccttgtcgaagacctgggtcagcggctggttgtcgacggccacggcgcgggcctcgcacatcagctcgctgatgctctccatgctttccatgatggtgttggtggcgctttccgtggcgccgacgatggcgtccaactgctcggacatgctgccgaaatggtcggtggcgccgggcggattaagggcggccagttctgtccggatcttctgaaggtgcccgaacagccccaccagctcccgcttgaggaggccactctcactgatcggtgtccgcatgttcattccgtcgccttcatactgaagtcagaggatagcctgtttatcaggaatacgccaaggcccatccctgtgactttaggtaacgtcagccttgcccgcgaaaggtgcggaccagagccctggcggccgcgcctggggccattcgcccgccggcgacgccgcgctccatatccggcagcatccgttcgacccggggatcgtcgcgcagggcctgcagcagcgtctcggacacctcgttccacatccaggcatgggcctgggcggcgcggcggtcggccagggcgccggccttgtccatggtgtcgcggtaggtggcgatggtcgaccacacctcgtcgatgcccgaccgcgccagggccgagcaggtcagcaccggcacggtccaatggggcgaggccggcgccagcaggtgcagggcgttcttgtagtcccgggcggcgcgggccgccgccgccgccagatcgccgtcggccttgttgacgatgatggcgtcggccagctcgacgatgcccttcttgatgccctgcagctcgtcgccgccgccgggcaccaggaccagcaggaacatgtcgaccatgtcggccaccgccgtctcggactgaccgacgcccacggtttccaccacgatgacgtcgaagcccgccgcctcgcagaccagcatggcctcgcgggtgcggcgcgccacgccgcccagggtgcagcccgaggggctggggcggatgaaggcgcgggcgtcgcgggacaggtcctccatgcgggtcttgtcgcccaggatggaaccgcccgagcgcggcgaagacggatcgacggccagcaccgccggcttcttgcccatctccagcacatgcaggccgaagctctcgatgaaggtgctcttgcccgctcccggcacgccggtgatgccgatgcgcaccgaccgtccggtatggggcagcaattcatgcatcagcgcctcggccgcctcgcggtggtcgggccgggtggattcgatcagggtgatggcacgggccagggcacggcgctcgccggccagcacaccctggctgagagccttgggatcgggggaaatgctcacgttgcgggctatctcttcttgtcgtcgggctcttggccctggttgagaaaggtgaggatggccatgctgaccagcttggcccggtcctcgtccgacagggcgtcgagaatcttgcgcttggcccggtggacctcctgggcgcgcttcaacagggcggcacggtccgaaccgggttcggccttggccgggggcaagggccggggagcggcagccttgggctttggcttcgccttgggcttgggcttttcctcgccgaacagggatttgaggaagccgaacatcacgaccctccgcccagcagcgccttgcgcgccacctgttccagcttgtcccgctcctcgtcggacagttcggccagcaccgattgccgcgcccggtgcaccagcatggccgagcggatcagctgggccttttccggcggcaggcgcttcatgcgttcctcggcctcggccaaagcggtggcggggtcgcgctccctggccctgggcgcgcccggattcgggcgagcggccgccttgggcgccgggcgcttgagcgcctcgcgcgcccgtttgtccagaaccagacgggacagccagccgagcatgatccaatgctacccgaaatccctcagcccaggtagcgccgccgcagatgggtctcgaacaccgtgggatcgagcggccgcgccgtcgcctgggtcatcaactgccgggtggacagcagcgagcccttggaatggacgttggcccgcagccagccgagcagcggccggaagtcgcccccggccagacccttcatcaccgccggatcggcgtggcaggcggcgtcgaacaattgggcggcggtcatggcgcccagcgtataggtggggaaatagccccaggcgccgccataccagtgaatgtcctgcaggcagcccagccggtcgtcgggcggcgtgatgcccagcaggcgctgatagccctcgttccaggcggcgggcaggtcctccaactccatccggccttcgatcagcgccttttccaggcgatagcggatgatgacgtgggcgggataggtgacctcgtcggcctcgacccggatgaacccccggctgaccttgatgccccggcggtagatgttgtcgggctcccaggccggcccctcggcgccgaacgtgcttttcagcagcggcgagaggaagccggcgaactccttggagcggcagacctgcatctccatgagcagcgattgggattcgtgcaccaccatgccgcgcgcccggcccaccggctgagggcgccaatggccggacggcaggccgaactcgtagagcgcgtggccggtctcgtgcagcacccccatcatggccgaggcgaaatcgtcctcgttataacgggtggtgacccggatatcgccgggatagccgccgcagaacgggtgatgggacacgtccaggcgaccgtggcggaagtcgaagcccagcacctccatcagacggatgccgagagccttttggcggtcggtggcgaaggggccgtccggctcgatgatcggcgggcgggcgttctgggcgtccagaacctcaccgatgaagccgggcaggaacgtctccaggtggtcgaagaccggatcgatctccgccgcacggcccagcggctcgtactggtcgagcagggcgtcgtagatggacacgcccagggcctcggccttgacgtgccccacctcgcgcaccagccccagcagcaccttcagggcgggcagcaccgccttgaaatcccccgccgggcgggcctggcgccagaccatctcgcaggcggattcggcccgcgcctgggcctccaccagatcggcgggcagagcgctggcatgaatccagtcgcggcgcatctcgcgcagattggccgcctgccaggcatccagcggctcggccgccgcgcgatcgagcaattcgcccatgtccggcgcggtgatctgttcgtgattgatgccgcgcagggtcgccacctgctcggcccgcatctcggcggcaccttcgggcatcatggtcgccatgtcccaggacagcaccgacagcgcctcggcgacggagttcatcttgcggaagcgggcttccagggtggcataggccggattggtgctcatgggactcacttggtatcgacgggtgagggaacgatagaccatggcccttgcttcggggaatcgtataatcgcccgagttttccccagccgaggataaggaacacgccatgaccgccaaaccccgcttcgccgtcgtcctgtccggctgcggcgtctatgacggcgccgaaattcacgaggccgtgctgaccctgctggccatcgaccggctgggcggcgcgtatcagtgcttcgcccccgaccgcgcccagatgcatgtggtcaaccacctcaccggccaggaagccgccggcgaaagccgcaacgtgctggtggaggcggcgcgcatcgcacgcggcgccatcaagccgctgaccgcgttcagcccggcggatttcgacgccatgatcttccccggcggcttcggcgccgccaagaacctctgcaccttcgccacccagggggccgagtgcaccgtcgatcccgacaccgaggcggcggtcaaggccatggcggcggcggccaagcccatgggcgccctgtgcatcgccccggccctgatggccaggatcttcggcaacggcatcgacgtcaccatcggcaatgacgacggcaccgccaaggccatcgaggccatgggcgccaagcacacccaggccgcccatggcggcgtggtggtggacaaggcccgcaaggtggtgacctcgccctgttacatgctggactcctccatctcccagatcgccgacggtgccgagaacacggtcaaggccctgctgaccctgatggggcgctgagagattcccagcggggcttccgccccggccccgaccgggaggaatgcctcccggacccgcccttgtttttgaaaatgaatggggtttggggcctaaggccccgtgcagccccgacggggcaaacgacgcaccgcaaggtgcggtcccgtagggacgaacgaagtgagcaagcaggtccgggcggcagcccgatcacccccgacgcaggaaggacaccccgcctcatggcccgcaagcgcaagggcgatcccgtcaacggctggctggccatcgacaagccgctgggcatcggctccacccaggtggtggccaaggtcaagcgcctgctcaacgccgccaaggtcggccacggcggcacgctggacccgctggcgtcgggtattctgcccatcgccctgggcgaggccaccaagacggtgcaatacgtcatggacgggtccaagacttaccgtttccaggtgcgctggggcgaggccaccgccagttgcgaccgggaatccgaggtgatcgagacctcgccccatcgccccacggccgaggccatcgccgccgccctgcccgccttcctgggcgagatcgaccagatcccgccagcctattccgccatcaagatcgacggccagcgcgcctacgacctggcccgcgccggggaagaggtggagatcaagccccgccgtgtcgccatcaaaagcttcaccctgctgggccagcccgacgccgaccacgccgatttcgaggtccattgcggcaagggcacctatgtgcgctccctggcccgggacctgtccctggcgctgggcaccgtgggccatgtctcggtgctgcgccgcatcgcctgcggcccattcaacgagcaaaacgcgatttcccttgaatccctggaggacttgagtcaagttcccgccccttggacctttctgcttcccatcgagaccgcgctggacgacatcccggcactggccctgacggaaagcgaggcccgccgcctccagagcggtaatcccgtgtcaatctcgcacgtggtttcccgacatccgcaggctgaactcgccgaaggcacagtgtgccgggcgatgcaggcagagcggttggtggcgttggttcgcatcgaaagcggcgaaatccgtccggtgcgggtcatgaatctcaccgaagaataggagtagacgatgtcgatcactgctgagcgtacccaggaactcgtcaaggaatacgcgaccaaggaaggtgacaccggctccgccgaggtccaggtcgccattctgtcggagcgcatccgcaacctgaccgagcacctgaagtctcacaagaaggatttccactcgcgccgcggcctgctgatcatggttggccagcgtcgtcgcatgctcgactacctgaaggccaaggacaacaagcgctacgagggcctgattggccgcctcggtctgcgcaagtaatcctgaccgacagacatacgaaggccgggcgtcgcctggaatgcacccgcgcggggatggctccgcgcgggtgaccgtatttgagccgtttgaaagtggccgatacgagaaattgacgccgggaccgaccgcaatccggcggcggtcctaaacataaggaagcgacttacatgtccatgttcaatgtccaccgcaaggaaatcacctggggcggccgcaagctggttctggagaccggcaaggtcgcccgtcaggccgacggcgccgtgatggtcacctatggcgaaacctcggtgctgtgcaccgtggtgggcgccaagagccagaagcccggcatcgacttcttccccctgacggtgaactaccaggagaaggcctttgccgcgggcaagatccccggtggcttcttcaagcgcgaaggccgtccgagcgagaaggagaccctggtctcccgcctgatcgaccgcccgatccgcccgctgttcgccgatggcttccgcaatgaagtgcaggtggtctgcaccgtgctgagccacgacctcgagaacgatcccgacatcgccgccctggtcggcacctcggccgccctgaccatttccggcctgcccttcatgggcccggtgggcgcggcccgcgtcggctatgtggacggcgcctatgtgctgaacccgctggtcggcgatctgcccaagagcgagctggacctggtggtcgccggcaccgtcgaaggcgtgctgatggtcgaatccgaagccaagcagttgtcggaagacgtcatgctgggcgccgtgatgttcggccaccgcgagttccaggcggtgatccaggcgatcatcgatctggccgaggaatgcgccaaggacccgtgggacctgcccgagccccccgccgaggtggcggtggtcaccggtaagttcaacgacgcgggcgtccccgccgaactggccgaagcctataagatcatcaagaagcaggaccgttacgccgccgtcggcgccgtgaagaagaaggccctggccctgttgaccgaggcggccgagatcgccgtggccggcggcatcctgaagcacctggaagccgatgtcgtccgtggcaacatcctgaagaccggcgtgcgcatcgacggccgcgacaccaagaccgtccgcgccatcgaggtcgaggtcggcgttctgccccgcgcccacggttccgccctgttcacccgcggcgagacccaggccctggtggtcgccactctgggcaccggccaggacgagcagatcatcgaccagctggcgggcgagtaccgcgagcacttcatgctgcactacaacttccctccctactcggtgggtgaagccggccgcatgggttcgcccggccgccgcgagatcggccacggcaagctggcctggcgcgccatgcgtccctgcctgccggccaaggagagcttcccctacaccatgcgcgtggtgtcggagatcaccgagtccaacggctcgtcgtccatggcctcggtctgcggttcgtccctggccctgatggatgccggcgtgcccctgcccaagccggtggcgggtatcgccatgggtctgatcaaggaaggcaccgacttcgccgtgctgtccgacatcctgggtgacgaggatcacctgggcgatatggacttcaaggtggccggcaccgtcgacggcgtcaccgccctgcagatggacatcaagatcacctcgatcaccgaggagatcatgaagatcgccctgggtcaggccaaggacggccgtatccacatcctgggcgagatgaacaagggcctggatcacgcccgtgattcggtgtcgggcaatgcgccgcgcatcaccaccatctccatccccaaggagaagatccgcgaagtcatcggcaccggcggcaaggtcatccgcgagatctgcgagcagaccggcgccaagatcgacatcgatgacgacggcaccatcaaggtcgcctcggtggacgccgatgccgcccagcgcgccatcgactggatccgcggcatcgtcgccgagcccgagctgggtgtgatctacaacggcaaggtcgtgaaggtcgtcgatttcggcgccttcgtgaacttcctgggctcgcgcgatggcctggtccacatctcggagctggcccgcgagcgcgtcgccaagaccgccgacgtggtcaagcagggcgacgtggtcaaggtcaaggtcctgggcttcgacgaccgcggcaaggtgaagctgtccatgaagcaggtggatcagaccaccggcgaggacatctccgcccagctggaagccgagcgcgccgcctccaagcgcgagcgtcaccacgaggattgatcctcggataggctttgaatgaaaaggcgcggttccgaaaggggccgcgcttttttactcataatgtcatcccgagcgaaagcgagggatctccgcctgggcgagcgtgtcaaaaccggacagggcatgccagaatgagatccctcgctctcgctcgggatgacaccgttgcagcggcacttctacgtctacatgctgtcgagcgtatccggcgtgctgtatgtcggcgtcaccaacgacctggctcgcagactgcaggagcatcggagcggtatcgcggacggattcacaaagcgctatcattgccatcggctggtctggttcgagatgaccggcgatgtgaacgccgccatagcccgagaaaagcagatcaagggctggaggcgctccaagaaagaacacctgatccgcgagacgaatccagcctgggcggatttggctcaggatttctgaaaactctcatcccgagcggatgcgagggatccccgtttggcacggcggcgccgagccggtaccatcggagcagaaagagattcctcggctccgcctcggaatgacagggatggtgaccatgaccgacaaagtggtgaagaccgaagccgagtggcaggcgcaactgagtcccggccaatacgccgtgacccggcagaaagccaccgagcggccgttctccggccaatacgaccaccacttccagccgggcaagtacgcctgcgtctgctgtggtcaggagctgttcctgtccgaggccaagttcaattccggctgcggctggcccgccttctccatgcccgccgctccgcaagcggtgaccgaggagcgggaccgcagccatggcatgatccgtaccgaggttctgtgctcgcgctgcgacgcccatctcgggcacgtcttcgacgacgggccgggaccgacggggctgcgctactgcatcaactcgctgtcgctcaagttcgaggcgccgtaagcttcaggtaaagctcttccaccttctgccgcgcccagggggtctggcgcaggaatttcaggctcgacttgatgctgggattgttgaagaagcattgcagattgatctgctggcacagcccggcccagccgtaatggcggaccagggtggtcagcacggtttccagcgtgatgccgtgaagggggttcttgggctgcggtccggtcatggccgcagcataatgcggccgaggcacatccgtccaattgcatccgcgacgattttgtcctaacaccaccccatgatcatcgtggcgaaagggccctttccatggcggacggacattccactcccgtgctcggcatcatcggcggttcgggcgtctatgacatcgacgggctgaccagcaaggaatggcgccgggtggaaagcccgttcggccccacctcggacgagttcctgttcggcgagctgaatggccagaagctggtcttcctgccccgccacgggcgcggccaccgcattcctccgtcggaactgaacttccgcgccaatatcgacgccatgaagcgggccggcgtcaccgagattctgtcggtctcggcggtgggctcgctcaaggaagagctgccgcccggcaccttcgtcatcgtcgaccagttcatcgaccgcaccttcgcgcggaccaagagcttcttcgaaagcggcctggtggcccatatctccatggcgcatccggtctgcggccgcctgggcgatctggtggaagccgccgccagggaggccggcatcatcgcggtgcggggcggcacctatttggtcatggaaggcccgcaattctccaccctggccgagagcaacctctatcgccagtggggctgcgacgtcatcggcatgaccaacatgcccgaggccaaattggcccgcgaggccgagatgtgctacgccagcgtcgccatggtcaccgattacgattgctggcatcccgaccacgacgcggtcaccgtggatgccatcgtcaaggtgctgctggccaatgccgaccgcgcccggtcgctggtcaaagccgtcaccccaaaggtctcgggccgcaacagcccctgcgccaagggctgccacaccgcgctcgacaacgccatcatcacccatggcgaggtccgcgacccggcggtggtcggcaagctcgacgccgtggcgggacgggtgctgaagggctagtgttttcgaatagcccatgagccaaggcccttcgcccgacgccgttctttgccggttgaggggtccgggcgaccccggcgcccgacattgaaagtccgggcaccttccaatgccggggcgccgatcccttccggaccgtggcgatatcctcgggccaaccggcacagccggactggtgccggtcgacctcaggaccggcgagaacagccgccacccccccgacgatcacgtcccgccaatccgagacggatggcccatccatcttggaaatgctggtttacgcatgcttcaaattggcgtatccccttaatatagggggtggacggccaagccgcgccacgtggaaaatttcagagaaattggagtttccctggtgaaaaaggtcgtgattccgtggcgattgccatcttacaagaggcttaacggctaccatcccttaatttccagctacgttgagagtgcgcccgaggacgtagtcttctcatttgctgaagacgccggaataacgcaggcctctctggcggaggttgccacaaacctcataagaatcggttgcaagcttggacagacaccaaatttcaacctcggcaaacacgatacctctgtaagtgagttttgcaagatcagcgacctggagtcgcaggctcgaattgagacggcggcgacgacggcggacattatatttcatcataccgccccgctacatcttggcacaaagccattcattctgcattttgagagcattacgccactattcatcccttttatttatcatgggtcgacgtgggacattgacatcaagtcgctgccattttttcactacataaagcaactccttgaaagcgacatgtgtcggggaatatttacgcacgtcaagagcagctatgatgtattcttgaggctatttgatagctgtgtcattgccgacaagaccagatacattacattgggcgtcagcgcgccggaacagttcgacaagcgaatttcagataagatcgatagtcagtcccgcgaccgactaaacatcgtcttcaccaactcgttccaaaactccgccgccggcttcttcgttcgcggcggctgggaggtcttgaaagcattccaggcccttcgcgcgacccacccccatgccaccctgacgatcctgtcggcgcgcacacaggatgtggacttcatggaaacaggccgccaccacgaaggcgtcacctggcttgatcaggggatcgaggaccagcaactattcgaacttttggcggatgccgatatcttcatgctgccggcggcgggattgcacagctactccgtcctgcgagcgatgagatttggcgcggtcctcatttgctctgacgctcccggatatgaggagtacgtgaccgataacgtcaatgccgtggtcatcagtgggcgacgcagccaaatctatcaaatcgatccatcgacgggctggatgcgcgacaattaccagtcggccttttcccttaaccgggagattatcgcagacctgaccaatgtgctggtccgtctggcggacaaccccgatgagcgccgccgcttgggccgtcaggcgctgatggacgtgaggaataagtatcggctggagccctgggtccgggagatcagccgaattattgcatcagcgtgagtgcagcggccactttgacccagccccgcttggctcgcggccgaatgccgcatcggccggcgcctcccggataggccgctcatccgccctgcggcgagccctgccgcaggaccatcgcaattgcctctctgggtcggagcatccgattgctccgttcggcggcatcccttagagtgccgccgtttcccctggagagcgccccatgaagatcaacggcaccccctaccgcaccatctggctggccaaggatggcaggacggtcgagatcatcgaccagacccgcctgccccacgaattcgtggtggtgccactggccagcctggaggatgccgccaaatccatcaaggacatgtgggtacggggcgcgccgctgatcggcgccaccgccgcctacggcatggccctggccaccctggccgatgcctccgacgccgggctggagcgggcctatcaggtgctgcacgccaccaggcccaccgccatcaacctgaaatgggccctggacgagatgatcgcggccttgaccccgctgcccgtgccggagcgcagtgccgccgcctatgcccgcgccgccgagatctgcgacgaggattcggcccagaacgccgcgctgggcgagcatggcgcggccatcatcgccgcccatcacaaggccaagaaccgcaccatcaacatcctcacccactgcaatgccggctggctggccacggtggattggggcacggcgctggcccccatctacaaggccttcgacgccggcattccgctgcatgtctgggtggacgagacccggccgcgcaaccagggcgccagcctgacggcgcgtgagctgaactggcacggcgtgccccatacggtgatcgccgacaacaccggcggccacctgatgcagcacggcatggtcgatctgtgcatcgtcggcaccgaccgcaccacccgcaacggcgacgtctgcaacaagatcggcacctacctgaaggccctggccgccaaggacaacaacgtgcccttctatgtgggcctgcccagcccgaccatcgactggaatgtggccgacggggtcaaggagatccccatcgaggagcggtccgaccgcgagcagacccacatcttcggcaagaccgaagacggcgtggtgcgcgaggtgcaggtcacccccgacggctcgcccgccgtcaattacggctttgacgtcacgccagcccgtctggtcaccggactgatcaccgagcgcggcgtgtgcgaggcctcgccggagggactgaaggggctgttccccgagcgggcataaaagacctgggctgccgcccagacccgcctggaggccgaacctccagaccaccctttgtttcaataagctggagggctcgggaggctgtgcctcccgactggggatcggggcgagagccccgaatgcctcactcgtcctcgcccgtatcgtcgatggtggtggcgcccagggccagcagagcctcgaccccggcatcggggatggcctcgaccttacgcaattgccggtcgatggcacgtttgcgcaccgccacgtcgtcgatggtcttggaggcctcctgaagcttcttctgcaccttgtcgagcacgtcgccgtacttgccgaactcggtcttgaccgcgcccagaatctcccagacctcggatgaccgcttctcgatggccatggtcttgaagcccatctggatggcgttgaggatggcgcccagggtggtcggcccggcggcgatgaccttgtagtcgcgctggatcaagtccaccagaccggggcggcgcagcacttcggcatacaggccttcggtgggcaggaacaggatggcgaagtcggtggtggtgggcggattgacgtatttgtcgcggatgtcgcgggcaaagctcttgaccctggtctccagccccttggcggcggcctcgacggcatcggggtcggcgcgctccacggccagttgcagccgctcgtaatcctcgttggggaatttggaatcgataggcagcagcacttccggctcgtcgtcgcccttgcccggcaggcggatggcgaagtcgacgcgctccaggctgcccttcttgcaattggcctcgcgcatgtactggtcggcgcggaagatctgttccagcagggcgcccaactgcacctcgccccaggttccgcgggtcttgacgttggtcagcacccgcttcaggtcgccgacgccgctggccaggctttgcatctcgcccaggcccttgtgcacctgttccagccgatcgctgaccagcttgaaggactcgcccaggcgcttttccaaagtaccctgcagcttctcgtccacggtctggcgcatctgttccagcttctgggtgttctcgccgcgcagcttttccagatgttcggagaccacccgggtctgttccgccacggtcttgccgatgccttcgcccaactgcttgatgccgcccagcacctcttcgcgcagggcgcgggcctgggtggcctgatccgagcggaactcggccagcttggtctccaccaggatgcgcagttcggtgtggttcttgtcagccgaagcggcggaatcgccctggaaggtgcggatcatctcggcggtctcgcgccggtcctggcgggcctcgtcacgcaacacccgctctagccggtcgaggcgctcggacagatcgtccttcttgcgcagcagcaggaccgccaccccgatcagggcaagcagggaaagagcggcggagatcagggcaaaatccatggcggcaatccgaacattacgggaacagtcgccttgtagcacgcatcacgggcggcggtaaaccacgaacaccagccgtgccgcgccacgcgggcgctcgtccaccgcatcgaaaccgggcggaggcgcaaaggcctcgtcggcggccacttccaccactgccagggcgccgccttccagccagcccttggcggccagaccttcgaggcacggcccggcgaggccggaatgatagggcgggtcgagaaaagccagggtgcaggcgtggggcgcggcaggcggcttggcggcgtcggcgcgcaggaccttgctctcgccctccaccttcagagccttgacgttggcgtagatggcggccaggggttgcgccgccagttccaggaagcaggcatgggccgcgccgcgcgacagggcctccaggcccagcgcccccgatccggcgaaggcgtccaccacgcgggcgccctccatctccaccagatcggaatgcatcaggatgtcgaacagcgcctggcgcacccgatcggcggtggggcgggtgtcgcggcccgaaggggcctccaggcggcggcccttatgaagaccggcgacgatgcgcatcgggcttgcccgcttgccgggcctcgtagggcttgtcttttttggcgctcgcggcgcgcttgtcctcggccagcttctgcttgcgggccttggcggcgacgcgctgttccttttcgcgctcgcccgccgacttggtctcggccttgggcttgaggaccgccttgccctcgcccatctgctcgcgcagcaccttgcccgccacctcgtcggcggcgccctcttccagggtgcccagttggaacgggccataggagacgcggatcaggcgcgagaccggccagcccagatattccatcacccggcggatttcgcggttcttgccctcgcgcaaggaaacgctcagccaggcattggcgccctggcggcggtccagggtggcgctgatgggaccataggccatgccgtcgatggtgatgccgttctccagccgggccagggcgtcttccgacacctcgccgtggacgcgcacccgatagcgccgcagccaggcattggaaggcagctccagcttgcgggccaactcgccgtcattggtcagcagcagcaggccttcggaattgaggtcgagccgtcccaccgagatcacccggggcataccctcgggcagatggtcgaacaccgtcggtcgcccctcggggtccttgtgggtggtgaccagaccggccggcttgtggtaacgccacagccgggtcttttccggctcggacaggggaatgccgtcgacgatgacgatgtcgcccggcccgaccacgcaggcgggagaactcaggcgatggccgttgacggtgacgcggccgtcctcgatccagcgttcggcctcgcgccgcgagcacaagcccgcacgggccagccgcttggcgatgcgctcgccttcgctttttgtttgcccctcagacaccgggcggtcgccctcgctcccttggctcctccgctgcgctccgggcgcctcagtggcgccgcgcttcggcttcgcctcgctcgaagtttgtccctcggacgccgggcggtcggtcttgctcatcggcatgctcctacaaaggcgcgcagcagggccgaatccgccgggctgatgtcatattcggggtgccattgcaccccgatgcagaacgtccgtcccgctgcctcgatcccctcgatcaccccgtcgggggcgatggcgttgaccacacagccgggcgccaccatgcgcaccgcctgatgatgggccgagttcaccgggatgcgggtctcgcccacgatttcggccagccgggtccccgaggcgatctccacccaatgtccgggctcggaacggggagtgggctgctcgtgggacagggcgccgttcacctcgtcgggaatgtgctggatcagggttccgcccagggcgacgttcagcaattgctgcccgccgcagatgccaagaatgggcatgtcgcgctccagcgcgccccgcaccatggccaactcgaactcggtccgcccccgcttcagcaccaggccggcgcgggcttcggcgccgaacagggcggggtcgatgtcgaaggccccgccggtgaccaccaatccgtcgatgcggtcgaggaacgaggcggccagccggggctcgtgcggcagcagcaccggcagaccgccggcgcgggccaccgtctcggcgtaattgcggcggagcgcgtaccacggcatgcgggaatagccgccgggttcctcgctgtcgagggtaatgccgatcagagggggcgaaaagctcatgaggccttctatacccccccggggccaaagaagaaaggcccgggcgaaaccgcccgggccagtttgtccggcatcagggggatgcgggagggttacggaatcatccaggtcaggacataggcctgaagcgtggtgatcacgccgatgatgcacacgaagaagacgctgtgcttcaaggtgaagcggaacaggttggcctcgtggcccaccagacccacggcggcgcaggccaccgcgatggactggggcgagatcatcttgccggtgacgccgccggtggtgttggcggcaaccatcaggatgtcgctgattcccagctgatgggcggtggtggcctggagcgctccgaacagggcgttggacgaggtgtccgagccggtgaggaacacgcccagccagcccaggaccggcgagaagaagggatagaaatcgccggcgccggtcagcagcagggccagggtggtggacaggcccgaggcattggccacataggcgaaggccagcaccgtgccgatggtgtagatggggcgcttcagctcgttcagggtctcgccgaaggtcttgagcccctccgagcccttcatccccagcatgatgatggtgatgatggccgagatcaggatggcggtgccggtggccgagaccaggttcagggtatagacggcgggcacggccttggcggcggcgacgatcggcggcaccttggcgaccaggttgtgcagggcgggcacttcccagttgatgttggtgaacaccagctcgccgcccttggcgaacatggccttgaagggcttcaggctccacaccgtcaccacggcggtgaggatcaggaacggcgcccaggcgcgggccacctgaccggtggtgtagtcgtgggagtgcttctcgtcctcgccctcttccttgaagcggaagatgttcttgggctgccagaacttgaggaacaccgtgatgcacaccaggctgatcagcgccgaggtgatgtcgggcagctccggcccgatatagttggaggtgaaccacacgccgaaggcgaacgagccaccggccaccaggatggcgggccaggtctcgcggacgcccttgaagccgtccatgatgaagatgatccagaacggcacgaacaccgccagcagcggcaactggcgaccggccatggcgccgatcttgaaagcgtccaggcccgagacctgaccggcgacgatgatcggaatgcccatggcgccaaaggccaccggggcggtgttggcgatcaggcacaggccggcggcgtaaagcgggttgaagcccaggcccaccagcagagcggcagtgatggccaccggcgcgccgaagcccgccgcaccctccaggaaggcgccgaacgagaagccgatcatcagcatctgcaggcgctggtcggcggtgatggacaccaccgaggagcggatgatctcgaactggccggtcttgaccgtgaccttatacaggaacaccgcgccgatgatgatccaggcgatgggccacaggccgaacaggaagccctggacgcccgccatgacggcggcggccaccggcatcttgtagaacacgatggccacggcgatggacagcagcacggtgatggtgccggccacatggcccttcagcttcaggatcgccagggcgacaaagaagaaaatgatcggaatggcggcgatcagtgacgacagccacagattcccggccgggtcgtagacttgcatccaagcttgcatggtgcctccccgaaggttcgaccgtgcatccgctgaagatgccggtgaggtgttggtgttgaaggtttcttgaacgtggtaacataatttgaccaagcgattagcgtggataactcgattcgtcttccgatgtaaatggaaaagttgccatgccaaaaatccatgattggctatgacccagcaccggcctatcctcatatcatgatgcacgccgcccccccgtcgccccccgggaccgccgccgaaccggcggccgatccgcttgcccgcctgctgcaggcgcatccggaaacggtcttcgattatttcgagttccgccgcgtgatggccggcaatgccgccgccctggccgccgagcgcgccacgcccgaggatctggcccggctgcgcacctgcatggaggccatggaaaaggcccacgccctggacgaccccgcccaggaggccgccaccgatgccgaattccatctggccatctacgaggccgcccacaatctggtgatgagtcaggtgatgcaccgtgtcttcgacatgctgaagatcggcgtcttctatgaccgcatcgacctttaccgccgccgcggcgtgcgcgacgccttcctgcgccagcatcaggccgtctggcaggccatcgccgccggcaatcccgaacaggcccgaaccatggccgagagccacattaactccaccgaggaagccctgcgcgaggcgcaattcgccaattcccgccgcgacgtcgccctgcgccgccgggccggttcggacctgaccggccgaccccgctgattttggcaaaataattttaccactttacgctattggtaagaatgctgtaaccatggtggtgccgaggctcgaccttcggccaaacaacatcggtggaacgcccatgcccaagcagcctcgcccggaaagcgtctacttcttcggaacctgcctgatcgacctgttctaccccgaggccggactggccgggatggagctgctgcagcgcgaaggcctcaaggtggtgttcccgcccaatcagacttgctgcggccagcccgcccgcaacaacggctaccaggacgaggcgcgcaaggtggcgcggctgcagatggattccttccccggcgactggcccatcgtggtgccgtcgggctcgtgcgccgggatgatgaagacccattaccccgagatgttcgagggcacccccgaccatgaccgcgccgtcgctttttcggcgcgggtgtacgaactgaccgagttcctggtggacgtcctgggcgtcaaactggtggacaagggccagaaggtgaccatcacctggcacccgtcctgccattcccagcgcgaagcgggcgtggtcgagcagcccaaggccctgctgcggcaactgaccaacgtcaccctggtggagaacccgcgcgagaaggaatgctgcggctttggcggcgccttcgccgtgcgccaggccgagatctcggcggccatggtcaccgacaaggtggcctccatcgaggaaaccggcgccacccaggtggtgtcgggcgattgcggctgcctgatgaacatcaccggcgccgccgagaaggccgccaagggcttcaagggccgccacatcgccgaattcatcctggagcgctgccatggccgctgaagcaagcaagatggaattcggcgccaaggcccatgtggcgctgaacgaccccaagctgcgcgccaatttccgccgcgccatggacggcctgatgaccaagcgggcggcccagttcgccgatgaggcggagtggaatgccctgcgcgcccggggcgcggcggcgcgcgccaatgccttggccaaactgcccgagttgctggaacagctcgaagccaattgcctgcggaacggcatccacgtccactgggccgagaccaccgccgaagccaacgccatcgtgctgggcatcctggaagcggcgggcgccaggacggtgatcaagggcaagtccatggtcaccgaggagatgcacctcaacgcccatctggaaaagcacggcatcacgccggtggaatccgacctgggcgagtacatcatccaactggcgggcgaggcgcccagccatatcgtcatgccctgcatccacaagaacaagaccgagatcgccgagctgtttcacgacaagatcgagggccagccctataccgagaacgtggacgagctgaccgccgccgcccgggctgcgctgcgcggtgccttcgccggggccgatgccggcatctcgggcgtcaatttcgccgtggccgagaccggcaccctggtgctgatcgagaacgagggcaacgggcgcctctccaccaccctgccgccgctgcacatcgcggtgaccggcatcgagaaggtgctggaaaagctcgacgacgtgccgccgctgctgtcgctgctgccccgctcggccaccggccagcccatcaccacctatgtcaacatgatctcctcgccccgcaaggagggcgagaaggacggccccaaggcggtgcatctggtgctgctggacaacgggcggtcccgcgtccacggcgacaccgagctgcgcgacaccctgcgctgcatccgctgcgccgcctgcatgaaccattgcccggtctataccagggtgggcggccacacctacaccttcacctatcccggccccatcggcaaattgctgaccccgcagatcgagggactggactgcgccggcgaccagccccacgcctcgaccctgtgccgggcctgcgccgatgtctgcccggtgcagattcccattcccgacctgctggtccgcctgcggaccgaatcggtgcggcccacccagggacaggcggtcaagggagcgggctcgtcggccaccacctccgagaccctgggatggaagggctggacgctgctctacgcctcgcccctggtctaccgcatcggaacaaagatgcttggctggttcggaaatctgatgccgtcctcggcccccatgctgaagcaatggacgagcgtgcgcaccaagccgaaattcgcccccaagagcctgcacgaactggcccgcgagaagggatactgcgatgaatagcccgcgtgagcgtattctggcccgcctgaaggccgcccctcagacggccgcgccactgcgtcccgactgggcgccgcccgcctatgacgcctcggcgcgcaaggccaagttcaaggccatgctggaggcctcccacgcagacgtgcacgaggtcaccgccgccgactggccgcagcgcctgaagaccatcctggccaacaagggcgtgggcaatatggtctatgccccggccaccccggcgggacggcaactggccgactcctgggcgggcagcggccccgagctgctggcctatgatcgcccggtggaggacttcaaggaagtgctggtcgccaaggccgatgccgccctgaccaccgcccggggcggaattgcccagaccggctcgctggtcctgtggcccacctcggacgagccccggctgatgagcctgctgccccccatccacgtggccctggtggaggagtccagcctgaccgattccctggccgagaccatccgcgtccagggctgggcatcgggcatgcccaccaatgccgtgctggtgtcggggccgtccaagaccgccgacatcgagcagaccctggcctatggcgtccatggccccaaggaactgatcgtcctgctgatcgggaaagactgaaacatgacccgcaccgcccccgactattccgccctgctccaggacctgaccggcgtgatgccggtcagccggctgatcaccgatccgctgcgccgtctggcctatggcaccgatgccagcttctaccggctggtgccccaggtggtagccgaagtgcgtgacgaggccgaggtcaagggcgtcctggccgcctgccgccgccatggcgccccggtcaccttccgcgccgccggcacctccctgtcgggccaggcggtcagcgattccgtgctgatgatcttagggaccggctggacccaggcggtggtcgaggacgagggcaagcgcatccgcctgcagcccggggtgatcggcgccgaggccaaccgccgcctggccgccttcgcccgcaagatcggccccgatccggccagcatcgattcctgcaagatcggcggcatcgccgccaacaacgccagcggcatgtgctgcggcacctcggataattcctaccagaccgtgatgtccatgcgcctggtcctggccgacggcaccctggtggataccggcaacccggaaagcgtcgccgccttccgcgcctcccatgccgagttgctgtcccggctggacgacatgggccggcgggtgcgggatgacgagaccctggccggccgcatccggcacaaattcgccatcaagaacaccaccggctattccctcaacgccctggtggacttcactgatccgctggacatcctcacccatctgatgatcgggtccgagggcaccctgggcttcatcgccgagatcacctaccgcaccgtccccgagcatgcccacaaggccagcgccctgctgctgttccccgacatcgccgaggcctgccgcgccgtggtggcgttgaagcaagccccggtctccgccgtggaactgatggaccgcgcctccttgcgctgcgtcgaggacaagccgggcatgcccgcccagatccggggactggccgacggcgtcacctcgctgctggtggaagcgcgcggcgagacggccgaggccctggccgccaatctggccgagatcggccgggtgctgtccggcgtcaccaccttgttcccgcccgccttcaccgacgatccctatgagtacggcacgctgtggaagatccgcaagggcctgttcccggccctgggcgccgtgcgcaaggtggggaccacggtgatcatcgaggacgtggccttccccatcgaatccctggccgccgccaccaccgatctggagcatctgtgccgcaagcacggctatgacgaggcgatcattttcggccatgccctggacggcaacctgcacttcaccttcacccaggatttcggcatcaaggaggaggtggaccgctacgcccgcttcatggacgaggtcgccgaactggtggtcaacaagtacgacggttccctgaaggccgagcacggaaccggccgcaacatggcccccttcgtcgaaatggaatggggcaccgaggccaccgccctgatgtgggacatcaagggcctgctcgacccgctgggcctgctcaatcccggcgtgctgctggacaaggacccccgcgcccacctgaacaatctgaagccgctgcccgccgccgattccctggtggacacctgcatcgagtgcggcttctgcgagcgcatgtgccccagccacggcctgacgctgtcgccccgccagcgcatcacctcgtggcgggaaatctcgcgccggaccgccgccaacgagaattccgacgagttgcgccgcctctacgattaccagggcatcgacacctgcgccgcctgcgggctgtgcgccaccgcctgcccggtgggcatcgagaccggccggctgaccaagtccctgcgcggccgccgcctgggcagcggcgcccatgccgtggggcaatgggcctcgcgccattacggcgccgccatggccgccacccggttcgggctgggggccgccgccctggtctccaggctggccggtccctccgccatggccgccatggcctcggggctccgcacgctgtcgggcggccgcactcccaagctgggcgagcatctgcccaccgccgccgatttcgcgccgccggccaatgccccgtcgggcgagcgggtggtgtacttccccacctgcgccgcccgcaccatgggccccgcctcgggcgacccggaaaaggactcgctgcccacggtcatgacccgggtgctggcccgcgctggcttcggggtggtgattcccgacggcgtcgagaatctgtgctgtggccaggccttcgaaagcaagggcctccaggccaccgccgacgccaaggccgccgaattggaagctgccctgttcaaggcctccgaccacggccggctgcccatcgtcatggacgcctcggcctgcgcctggcgcatgaagacctatctgggcgagcggctcaaggtggtggactcggtggagttcctgcatgatgccgcgctgccccgcctgtcccccacgccccaggacgcccccgtgctggtccatgtcaattgcggcgcccgcaagcagggtctggacgacaagatggtcgggctggccaaggcctgcgccaagacggccatcgtccctgaggcggtgggctgctgcggcttcgccggcgacaagggcttcaccaatcccgagctcaacgaccacgcgctgcggcatctggccccccaggtgccccagggctgcgaggcgggctattcctccaaccgcacctgcgagatcggcctggccgatcatgccgacgtgccgtatcgctccatcgtctatctgctggaccggacgacacggtagggacttgcccgcgccggcagctcatgccagcctctcctgcaaataaatacgcaaggagaggctgaaatgagcgagttggtattgtcccatgtggaaggcggcgttcaggtggtccgcatgaaccgcccggacaagaagaacgccctgatcggcgagatgtacgccgccctggccgaggccttcgccaagggcgaggccgatgacgacgtgaacgtcttcctgatcctgggcagccagaccgacttttccgccggcaacgacctgcctgacttcctgacctgggaggcgctgagcggttcggtggccgaccgcttcatccgcgccgtggcgggagccaggaagccggtggtggcggccgtgcgcggcgcggccatcggcatcggctcgaccctgctgccccattgcgatctggtctatgccgcgccgggaacccgtttccacatgccgttcatcaatctgggcatcgtgcccgaggccggctccagccagaccatgcccgccctcgctggtcatcgccgcgccgccgagatgctgatgctgggcgagcccttcggagtggacaccgccgaggccgtcggcctgatcaacggcgtggtgccgggcgaggatctggaggaaaccgccatggcggcggcccgcaagctggcggccaagccgcgctccatcctggtgcagatcaaggcgctgatgaagactccggccgagccgatcatggatcgcctgacccgcgaggcggcggtgttcgacacctgcctgaagggcgaagccctgaatgaggccgtctccgccttcaaggagaagcgggcacccgatttctccaagtgccgctaatgcggccgggagggccgcgctcctggaccaaaccagagcgcgggcatcctgtcctttcccttaccccgcttgcgcggcagggctaccgccctggcccgttcgaaggcacagcctccgaaccaccagattctttataaaaactgaagggttctggaagccgtgcttcccgattgggggatcgggggcaaacgcccccgatggagagctctccgcaacctgcctgcaggatcctacttcttcatgatccggctgaccgacagcatggcctccatgggtcggcggccgggggcggagatcgaggtgaccagggccagaggctggctgccgtcctcggcgaagcgccggcccagatcgcgggcgaaccagtcggcgggcatcagatagtagtcgctgatcagctgaccggcctcgtcgcgggcttcgagcgccagcagttgcgcgccgcccttcagcccccccttttccaccatggccagaagatgtcgctgcagcgaggtggcgtcgccgtattcggaccagaccgtacagatgccgtccttgcccgccaccagggtaacggcccccaggccggggcggcgcagcacgcgaaccaaaccctgacgtcccgtcagaaaggtctcggccacctcgggcgccacatcggtgaagccgaactcgccggtaggcgaggcggcggtgatgatggcgttgtaatcacccacgttgagcacgcagatgcgtcccagcaccgccaccgccagccgcgacgtctcgtcgcgggtggccagaccgcccatggtctgggcctgggccggcagggccagcagaaccagcagcaatgtggcgagtatccggctcatggctgcctcactccgatggtgatgatggcctgaagatcgggattggcgctttccgaggtggtgacgatcacccgcagcccggtgggctcggccccgtgcgtcttgaccagttcatcgcggtacgtggcggtgggcgtaaggtcgagaaagcgcgaggtcagcggtccgttgctctcgcgcccgccggcctggacattgaaatagcgcccgaccgccgccttcaggtctttttccacctgggcattgatggcggaggtggagacccgacggacaaagaccgcgcattgatcgtccttggtcagcagcgccagggtgacgccggcatcctcgcgcagataggcctcgcccggacggccctggagaaacggcttggccgcctgatcggacaggcggggaaggtagaggtctccgccgggctgcaaccgctgcctcagcttgtccagcgcccccacatgggcggcgcagcccagcacgaaggtggccgaagcgatctcggccacgttgcgcggcggctcggcggccgagacgggctggaccgccacggcggcggccatgccgagggctaggaacagccggctcatgcgcattgccggggcacgaaggtcttgatccgcatatcctgctgcgtcacatgctccaccagggcctccatcaaggcgtgggcgcccagcaggcaatcgagcaggcaatcggcggcatggatttccgcaaccacggactcggtcctggccagcaggcgctcgtgctcctgctggtggatgggcagggcgggaaagccgatgcgggccatcaatcgctcctcgtcggcgaaatgggtacgcagattggtgatgaacgcgctgcaataggcgacgatttcatccttgggctcctccgaggccagggcggcgcgcagggcggccgcctcctcgaagaaggcgcgatgctgggcatccaccaggggatcgcccagggcgaactcctcgctccaccggtattgccataatgcgttgccgctcatgaccccttacactcccgaacccatggccgactggcgcgaacgttgctgcatcttgccccaggcgaaatcccgggcccgtcgtcccagccagccccggggatcaagccccaccgccttgaccaccatgctggccgcccgctcggcatgcaccttgccataaagtgcataggcacgcgaggcataggcggcgttgcagcgccgccggtcgtaaaccgcctcctcgggctcattggccgcgaaccaggcataggccaactcgtcgtcgtcgctttcgcggatacgccccaccgccaccagggcccggcgccagaccggcagccgatcccgcccctggcgatggcgcatggcggtgtagaacagcttgtaatgccggaactcgtcgccggcaatgcgatggcacagctcgcgcagcaccggctcccgggtagcgtcgcgaacggcgcaataaaaggacgaggttccggtctcgacgatgcagcgggccagcaattcgccggtgaccgatccccgcaccgaggtttcggcatccaccgggatgcggtagccgtcggtgaaccgctggaaccgccgggcgaagacaaaggaaggatcggccatctcggcatagcggcccagggcctcgccgtggcggatctcgtcggcccgccactgttcgaggatggcgacgaaggcgggatcatcacggaacacccgggcaagatacaaggtgtagtcggcagcattgcgctcgaccatggcggcggccttgatcaccttcaggataccgtcgttcacctgaccgggatcgaaccggtcccaggcgatgtcgtcggcgctccatcccgtcctgccttgcatgtccgctcccgcgtgaagcccccattctgtggcaagaaaggggattttcaagacaaaagggccgcccccggcgggagcggccctttcgcgaaacgatgatgcgccgatcaggcgaccgcggcggccatggcttcggccaccagcatcaggcggccggcatgggccttgtcccgatccgacttggcgtcgtccagggcttccttggcggccttcttgcgggcttcggccatctcagcggtcagttcgcccaccggaatggcttcctcggccaggacggtgatgcgctcttcgttgacctcagcgaaaccgccggccacgaaaaccgaggacgagaccttgccgccgtcatggatgtcgatgacacccggacgcacggtggtgatcatcggggcgtgcagggccagggcaccgaaatcgccttcggctccgggcaccacgaccatgtccaccttggacgaaaccaacagcttcgccggggacaccaattcgaactgaatcttctcggccatgccgcgagtccttcaacttttttagcggcgggtccccgaaggaacccgcccctaattattcccgaaagccttaggccgcctcggcagccatcttcttggccttctcgatcacctcgtcgatgccgccaaccatgtagaaggcagcctcggggaggtggtcgtattcgccggcgacgatggccttgaagcccttgatggtgtcgtcgatggccaccagcttgcccggcgaaccggtgaagatttcggccacgtggaagggctgggacaggaagcgctggatcttacgagcgcgcgacacgaccagcttgtcctcttccgacagctcgtccatgcccaggatggcgatgatgtcctgcagcgacttgtaggtctgcaggatgcgctgcacgtcgcgggcggtctggtagtgatcgttgccgaccacgcggggatccagaacgcgagaggtggagtcgagcggatccacggccgggtagatgcccagctcggcgatctgacgattcagcacggtggtggcgtccaagtgggcgaacgacgtggccggagccgggtcggtgagatcgtcggccggcacgtaaatggcctgcaccgaggtgatcgagcccttcttggtggaggtgatgcgctcctgcagggcgcccatgtcggtggcgagagtgggctgatagcccaccgccgacgggatgcggcccagcagcgcggacacttccgaaccggcctgagtgaagcggaagatgttgtccacgaagaacagcacgtcctgaccttccacgtcgcggaagtactcggcgacggtcaggcccgacagggcgacgcgggcacgggcgcccgggggctcgttcatctggccgtacaccagggccaccttggagcccgggccgtccagcttgatgacgcccgactcgatcatctcgtgatagaggtcgttgccttcacgggtacgctcgcccacgccggcgaacaccgagtaaccgccgtgcgccttggcgatgttgttgatcagctccatgatcagcacggtcttgcccacgccggcgccgccgcacaggccgatcttgccgcccttgcagtacggggccagcaggtcgatgaccttgatgccggtgaccaggatctcggtctcggtggactggtcgacgaattccggggcgtcggcatggatcggcagggtggtcttgttgccgatggggccgcgctcgtcgatgggctcgccgatcacgttgatgatgcggcccagggtctcggggccgacgggcatctggatggcggcgccggtgtccaccacttcggtgccacgggtcagaccgtccgtggagtccatggcgatggtacgcacggtggactcgcccagatgctgagcgacttcgagaaccagcttcttgccctgatgttccaggtgaagcgcgctgaggatggccggcagctggccgtcgaagcgcacgtccacgacggcgcccaggacctgggtaatcgtgccgacgttcttgtttgccatggtgtgctcctagtcttccgtcacagcgcttcggcgccggagatgatttcgatcagttccttggtgatctgggcctggcgcgaccggttgtacttgatcgccaaggcattgatcatgtcgcccgcattacgcgtcgcgttgtccatcgcggtcatgcgcgcgccctgctccgaagcctggctttccagcagggcacggaacatctgggtcgccagattgcgcggcaggatttcggccaggatttcttcttcgctgggctcgaactcgtagatggccttcggtccggtctcggacttggcggcctgctcgggcaccgggaagggaatcacctgctggcgggtcacttcctgggcgatggccgacttgaacttgttgtagaccacggtgcagacatcgaattcctccgcatcgaacatggcggagatctgcgacgcgacctgatcggcctcggcgaagacgatgcccttgcggcccaggttctcgaagccctcgatcatgtactggccatagtcacggcgcagctgctcgcgggccttgcggcccaccggcatgatcttgatggtcttgccctgcttcagcagatcagcggccatcgccttggtggcgcggacgatgctcgaattgaagccgccgcacagaccgcgatcggcggtcaccgcgacaagcagatgcaccttgtcgaatccggtgccggagatcatgcggggcgcacccgactggccagccagcgaggcggccagggtgcccagcatgcgctccatgcgctcggcgaacggccgtgccgcttccgccgcggtttgcgcgcggcggagcttcgaggcagcgaccatcttcatggcggacgtgatcttgcgcgtcgatttgacgctcacgatcttcatccgcaggtccttgagactcgccataacctaaactcccacgggacggttaagcgaaggtcttggagaacgcgtcgaggaacgccttgagcttctcttcggtctgggcgctgatctgcttctcggtggcgatggcggtcagaatttccggcgccttcgacttgatttccgacagcagggacgactcgaagcggccgacctggcgcacgtcgatcttgtccagatagcccttcacgccggcgtagatggaaatgacttcctcttccgtcgccatgggcgagaactgcggctgcttcagcagctcggtcagacgcgcgccacgggccagcagcttctgggtggccggatccaggtcggaagcgaactgcgcgaaggcagccatttcacgatactgggccagttccagcttgatcgagcccgcaacctgcttcatcgccttgatctgggcggcggagccgacgcgcgacaccgacagaccgacgttcacggcggggcggatgcccttatagaacagttcggtttccaggaagatctggccgtcggtgatcgagatcacgttggtggggatgtaggccgacacgtcgttggcctgggtctcgatgaccggcagagcggtcagcgagccggcgccggcggcgtcgcccatcttggcggcgcgctcgagcaggcgcgagtgcaggtagaacacgtcgccgggataggcttcgcggcccggcgggcggcgcagcagcagcgacatctgacggtaggcgacggcctgcttggacagatcatcatagatgatcagggcatgcatgccgttgtcgcgaaaatactcgcccatggtgcagccggcgtagggggcgatgaactgcagcggagcgggctccgacgcggtcgcggccaccacgatggtgtagtccatggcgccgtaatcggtcagggtcttgacgatctgggcgacggtggagcgcttctgaccgacggcgacgtagatgcagaacagcttcgccttctcgtcgttggcgtcatgccagcgcttctggttgatgatggtgtcgaccaggatggcggtcttgccggtctggcgatcgccgatgaccagctcgcgctgaccgcggccgatggggatcagggcgtccacggccttgatgccggtggacatgggctcgtgcaccgacttacgcggaatgatgcccggggccttgacgtccacgcgctggcgcgaagcagcctcgatggggcccttgccgtcgatgggattgccgagagcgtcgacgacgcggcccagcaggcccttgccgaccggaacgtccacgatggagccggtccgcttgacgacgtcgccttccttgatgttgcggtcgtcgccgaagatcacgacaccgacattgtcggtctcgaggttcagcgccatacccttgatgccacccgggaattcgaccatctcgccggcctggaccttgtcgaggccgtgcacgcgggcgatgccgtcaccgacagacagcacctgaccgacctcggcaacttccgcctcggtcccgaaggtggcgatctgttgcttgaggattgcggagatttccgcggcgcggatttccattatccaacccctttcatagcgagcttgagatgctgcagcttcgtcttcagcgagctgtcaaccatgcgggaaccgacctgaaccaccaggccgcccagcaagctgggatcaaccttgacgtcgacggcgacattgccgccgaaggctgccttaagggcggtggtaagggcgtcttgctgggccggcgagagagccacggcggaagccaccgtcgcggacttttccccgcgacgggccgccaaccggccaagataggatgcaatcacccccgaaagggtgtgcagccggcggttttgagccgccagaccaagaaatttgttcgtcagctcggaaaagccggcggccttggcaacggcggagatcgccttgccctggtcgttgcggctcagcacggggctgtcgacgacgcggcgcaggtccgcgctttcgcgcagcatggcctggagcgtcttgagatcaccggcaacctggtcgagcgagccggaagaatcggccaactcgaagagagcggtggcatagcggtcggcgatcacgccaatagtttcggaaggcacctgggcaagtccttggatagggtcgaaccggcagccgtaacctattgaaaggcaacataattctggcgcctgcaggattagcccccctgtcggcgcgtcggttaactagcacatagagttttgcgttgcaagacgagtcctgcccattcgggggaggagagcgaattatccttcatccgccgggcgcgccactgcacgccaaaacaagggtgggggcctgggtgggacgacctacccgtccgccacattttttttcgtgccggcggacccgcggtgctaatcttgggcggccgccgccccgtcttgccccttcgaggaccccatgccctactacaccttccgctgcaccggctgcggcaccgagttcgagaccctggtccgctcctccgacgcgtccccggcctgcccccaatgcggcagccaggccctggagcgccagatgggcgccaccgcccccgccgccaagacgcccggcgtggtgagccaggcccgcgcccgggcggcccgcgagggccatttcagcaattacgcccggtcagagatcaagcgaaaatagcgccaccattccgatagtgtcgctataaacgcatcacatcgccgacagcgccattaccggggaagtcaggcgttatgagggagagtcggcgcgtcccgatacgggtaatacgccgaccatccgatgttaggcccgcctcacggaacgccccccgcccggctgagatattccttctttttttccatgtcgccgtcgctgtcggcgaagcgggcggcgatggccttgaactcgtcctccagggcgagaaaggcctcgacgatatcggggtcgaaatgggaaccgctgccctcgcggatgatctgcaccgccgtggcgtggggcatgccctccttgtagacccggcggctgatcagggcgtcgtagacgtcggccaccgccatcaggcgggcggagacagggatgtcgtcgccgccaatcccccgggggtagccgctgccgtcccacttttcctggtgggcataggcgatttccttggccatggacaaaaaggccaccggcgtgcccagggattgctcggcgtgctcgatggcatcgcgtcccagggtggtgtgggtcttcatgatctcgaattcggcgggctcgaaccgtcccggcttcagcaggatgcggtcaggaatgccgaccttgccgatgtcgtgcagcggcgccgatttgaacagcatgtcgacgacgccgtcgtcaagcgaggatgagaaacgagggtggtccctgagtttcagggccagggcacggacatagtactgggtccgccggatatggttgccggtgtcggaatcccgcgtctcggccagggaggccatggccagaatcgtcacgtcctgaatggcggccagttcccgggtacggcgcgtcacctcggtctccagatacgcggtcttgtcgcgcaggaaatcggcgctggccttgagcttcaggtgggtctcgacccgggccagcaccacggccggagtgatgggcttggtgatgtagtccaccgcccccatcttgagccccacctcctcgtcctcgctgccgctcatggcggtgagaaagatcaccgggatgtcgcgggttgctctgctggccttgaggcgcctgcacacctcgtagccgtcgacctcgggcatcatgatgtccagcaggatcaggtcgggcggcgcatcggacgccgcgatggccagcgccttctcgccgccgttggcgatcttgacccggtagaggtccttcagcagcccgctcatcagcttcaggttgtcgggcgtgtcgtcgaccaccaggatggtcgggcggatgtcgtcgctcatgcttcattcccctcaatcgccgggcggctcatggcagcgtcaccttcagggcgcgctcgatggatttcttgacggcggcgatggagaccggcttgaccaggtagcccgagaccttgagccccttggcggtcatcaccgcctcctcgcccgaatccgaagtcagcatcaccacgggaatggcggccacttcgggaatcggggcccgctgcagcgtcgccacataggcgaagccgtcctcgcccggcatgtggatgtcgcacagcacgacggaggggcggatgcgcaaggtctctgagatggcggccttgacgtcgccggcatcgtagaggttggacggcggaatgccgatctgcatgaggatctggcgaagggtcagccggatgaaaggctcgtcatccaccagaagcaccttgatccggcgcagttccgtttcgttcatgggacacctctgtcatcgaggaccggcgcgagggcgtcgcgcagttcactcagggtggggggcagcagcgggatcagcatgccggcggccgcgtcgttaccatcccgggccgagttttccacatcggcggccagacgaccaaggcgcagggctccggcggtattggcggtgcccttgagaccatgggccacctcgcgcagagcggcgagatcggtctcggcctccaggcgcgccaccttggtcccggcatcgtcaaggaaggcggccaggatggggcgcagccgcgccatgtcccatttgtagatgggccccatgcgttcgaagtcgaacacgtcgggatcgatctcgggaaggagggggacggccccggccggggcggcgggggccacgaccgccgtcggcgccaccccgcgccatttcagcaggcaggcgaacagttcgtcgggatcgatgggcttggtcaggtagtcgttcatcccggcggcggcgcatctgtcgcggtcggcctgcatggcattggcggtcatggcgatgaccggcaggtcgccgaagcccagacggcggatttcccgcgtcgcggcgacaccgtccatgaccggcatctgcatgtccatcagcaccatgtcgtagggggcggccatgaccatatccacggcgatcttgccgttctcggccacctccacctccacgccgccatcggccagcagttcggtggccacctgctggttgaagtcgttgtcctccgccaacagcacgcgcagcccccgaagcgacgccagggcgtcgtctgacacctcgcgcccggcggccgcctcctcgggatcgccctccagcgccgctcccagggcgcgcatgaccgcgtcaaacatgatggaggggttgaccggcttgatcagcacatcctcaatcccggcggattcggccgccttcatcacctcctcgcggccatgggcggtgaccatgatcatgtggggcggactggttaggccgaggccgaggatggccctggccgtctcgattccgtccatgcccggcatctgccaatcgaggaagacgacctcgaacggcttggcgccggcgacctcgcgcaccctggcaacggccgccgccccggactccaccgcctcgacccggaaggacatggaggtcagcatgtccaccaacacggcacgggcattctcgttgtcgtcgaccaccagcatgtggcggccgcgcaggtccggcttgggaaccagggcgcggcgcggcctgcccttgcccaggcaggcggtgaaccagaaggtcgagccccggcccggctggctttccacccccacctcgccgtccatcagttcggccagcttcctggagatggccagccccagtccggtaccgccgtatttgcgggtggtggaggtgtcggcctgctggaagctctggaacagacggcccatctgctccgcgctgagcccaatgccggtgtccctgacctcgaagcgcagccggaccgcctcgcccagatcctcggccagccggacggccacgacgatctcgcccgtctcggtgaacttcaccgcgttgttggcgtagttgatcaggatctgccccagccggagcggatcgccgaccatgtcgttgggcacgtcggacgccacgtcgaagatcagttccagccccttggcgatggtcttttcgctgatcaggttggcgacgttgtccaggacggtatcgagatgcacggcggtcttttccaccgacagcttgccggcctcgatcttggagaagtcgaggatgtcgttgatgattcccagcagatgctggcccgattgctggatcttgcgcacatagtcccgctggcgcggattgagctcggtcttcagcgccagatggctcatgccgatgatggcgttcatgggggtgcggatctcgtggctcatattggccaggaaatcggccttggcctgggatgccgcctcggcgcgatccagggcctgatgcagcagggcgtcggccctcttgcgctcggtgatgtcgcggaaggtcaccacggttcccacgacggtgccgtccttgagcaccggcgtggtggagtactccaccgggaagctggtgccgtccttgcgccaaagtacctcgtccacctcggtccggggctggccgtcctggctggtgaggaacatggagcagcattcgcggggaaatggagtgccgtcgggataagtgtgatgcgccagggcgtgcaagggcttgccgacgatttcgtcgagaccgtagcccagcatgcgggcgccggccgggttgacgaaggacatggtgccgtcctgggccaagccgcagatgccctcgtccaccgaccccaggatcaggcgcgagcgctcctccgcctcggccagttgcccgttgatggcctccagttcctccttgcgcgccgccacctggcgctcggaggcggccagggtggcggcctggacccgggtctcctccagcagggcggcggttttggcgccgcgttccagaatctccagactcatggccaagaccggcagggccccgtccagcagggattgctcggcggggccgaaggcctccagtgtcgccagttccaccaccgccagcaggcgttcccctcgcagtaccggcaggacggcgatggtcttgggcaccatctcggccatgccgcaatcgatgcggacatagtccgagggcggccgggtgatgatgaagggcgagcgctccagggcacattgaccgatcagtccctcgcccatggcgaaggtctggtccagggtcttgcgctggcggaaggcatagccgcccagcaggcgcaggcgcccggcctcctcctcgtggatgtagaacaccccgtggccgaccttgagcagcggcgccatgacggacaggaaggtctgggccagaccggccatggttgtcgcggcctgaagctcggccgacagattggccaggtgggtcttgacccagcgctgggattccatctgcagcgcctcgccgcgcagcacgtcgatggagcgggccagggcgccgatctcgttgggatagtcggtatgggggacggcctgatccaactggcctcccaccagcttttccaccacgtcccgcacccgggtggcgggacggcggatggacatgccgatcagcacggcgaacagcagacccatcccgccgccgccgaggagaagcagcagggtcagacgctgcccgcgctcgtagccctcctgggccaggcgggcggattcctgcgcgccgcgttccttgacccggaccacggcctccagagcctcgtccgaggcggccgccaccagctggaaggccggcgtggcgacaaagaccgcggcatcggcgggattcgtccgcaacagcgccaccgcctgatccacattggccttgaagtccttgaagccgtcatcgaagcgggcaaggttgcgccggttttcctcgcggacgagagtcggacggacatggctcatttcggtatgcagcgccgcttcggcctgcgacagctgccgcagggccctatcgcgctcggccggctcgcgggccaggatggcctgacgcaaggcccgccccatcttggccagttcgatgcgcccgtccttcaggctggagatgcccaccagctcccgggtgtaaagggtctggatctcgtcgttcagccccctttggacaagcaggctgtagaggcccaggccgacgatcatcagcaggaagaccgaaaagccgagaaccagcttggtggtcagtcgcaggcgctccagggcgttcagaaggaaggtcatgacaatgcctcgcgggtgtcggccacggcgccccgatgccggcgctggatttccaggttgagggccagcagcgacgccatttccatgaactggccatgcaccagggggtccggcggatcgagaaccgcgatttccgcgacgcccaggaccgcgtcgtccagcagcagcggcgccatcatcaccgccgccggccgggcgctccccaggccggaccggatggtccaggcctgagcgtcgctgacgtcgagaatgcgcggctgccgctcggccacgcattgaccgagcagcccctcgcccggcgccaggagcggcggcgtggcggcgtcacaggcgaagcgccccgccagatggaagacgccgtctccgctgccgtcatcggcgtaaataaggccctgcagcgccccgaagatgcggtggcactcggccaggaaggcgtcggccagttcccgcgtcgaccgagcccgctggaagagcagcgccgattcggcccgtcgcgtcttgcgctctgcaccggcggcctgggcagcggcgtagtcttccaggcgccgtgccgccaggacctgggcatggtgactgtgcagcatcttcagaccaaggccgcagaagaccagcaagagggccgccgtcgccaatcccaccgcaaggctctcgccggccggcacggtccgcgtgagatcttccatcagcaccagggaccagtcgccataagggtcgttccaggtcaccgtggaggctgcctgggcatgacggcgtccccccagatccaccacgcctccttcgacggcaaagggcaggatcgatggctcggcccgatcgaacatggcgccaaactgcttgagcgcccggatggcgctcaagcgctccggattcggctgccccgccaggaagccgatccattccgggcgattcgaggcgaacaccacgccctggggggacaacagcagcgccacgtccgacctgccctgcaacagggaatccacctgggacaaagtggtgcgggccaccaccgtcccgacggcttcggcattgcgacccgccatggcgcgcaccggagtggcgaagtagagggcgcggtcgccacgggccagactgacggcggcatagacgttgtcatggcccttcatggacgtctgaaaatagggccggaagcgaacatccagccccgtcgagggcttgccgcccatatcccacgacgatctgatccgaccgtccccgccaacgatgaagacaccctcggcaccatgagaacggccaaccgcctcaagcaaccgggaaacccggggaccattgggcggaaaggttcccaaggcgtcaccccgaacctcctcgtcggtcatgccgagcaaagagagcgaccccatgatattgccgttcagggtctgcgacatcaattcgacgccgctgcgctgggcctcgatccgcagccgcgaaagccgctcatcgtcgcggcgttcgcgaaccgcccataccgccatggccgagccgatcgccacgaccagcaacgccaagatccaggccagccgggcatgcccggtcgcgaaagcggcaatgcggttcaaaacgcccccggcctttggtgcggtctctcaaccggaaacacacggatcccgataaggtactccatccttcaggcatatgaaatccgctgtttccacgttcccccttccggcagaagtaccgcgtctggcggccagggagaaagcccgtcccgcagccacgcacagctctgccgccagaatccgtcgcgatgacgggcatggaacaggccgaaatgccccacatccgcaaagcccagatcggcgggagccagcgacaccctctgccgctcgctgttccggtaatagctcagcccgcgaaggatggctcggggcgtcccgaattcatcatcggccatgcccaccgccaaaatctgcgcccgtacggcggcgaagcggtcgaggatcagcgggcgttcgtgctggggatagctgacctccatcttctcgcggcgaaagctccactcatgagccacgccggcgggtagatcctccagccagcccagccgccgtcccgggaaatagcccagcagagcggtcagcaccggcatcgcaacatgccatttcagcatcagccgcagacgccggtcggcggcatagtcccgccaataggcgtattgcgcccccacggtcagaagacggtcgatgcgagcggcgccgggggcaaagcccggaagaaagccgccgatgctgtgcccgaccactgccagcattccatcggggcgccgccgctgcgcccaggcgatggccgcgtcgaaatccagctcgccccaatcgcgccagcgaatcccggcaccctgaatccgccccggccgcgacaggccgatgccgcgataatcgtaggtcaggaccgcgaacccctgttcggccagaaagcgtgcgtagcggtgatagtagcgggccagcactccggtggcgggattgatgatgacggttcccgcgtccaccgccccctcggggcgccagaaatgccccagcagttcgtagccgtcgcggcacagaagggagatgggctccatgaccatgccccctcacgcctggaccgggcgagcaagccccgccggcgtattgccgatgggaaagtgcagcagggccgccaccagtcccgaggcagccgtcgccgcccagatcagggaataggacccggtcaggtccagcaccagcccccccagccaggccccgagaaacgagccgatctgatggctgaggaaacacagtccgaacagtgcgcccagatgctgcaccccgaagatccgggccaccagcccgctggtcaggggcaccgtccccagccaggtcaatcccatgatcgccgcgaagatcaccacggatatctcgcttttgggcagggcgacgaaggtggtgatggcggctccccggatcaggtacagccagcccagcaccggcccctgggcgaagcgcccgcccagccagccgcatccccagcttcccgccatgttgaacagcccgatcagcgccagtgccatggcgcccaggcccaccggcatatggcacagggacaggtagcccggcagatgggtggcgatgaaagccagttggaaaccgcaggcgaagaacccgacggtcagcaggcgatagccccggtgacgcgccgcctgcgccaggatggccccgagcggcggaccggccgaggattgcggcgggaccggctcgtctcggcgaagaaagaaccccaggggcgccgccgccaggatcacggcggccaggaccaacaacgaccaggccatgccgccgcttgcggtgaccgactggaccaccgggaccaggagaacctgcccgagcgacccgccggcgctggccagacccatggccatgctccgggtttcgggcggcgccatcttgccgattgcggtcatgaccacgccgaagctggtgcagctgatcccgatccccaccagcaggcccatgccgaggacgagggcggcgtcgctggccaccagggcggacagggccagccccccggcataggcaagcgcaccgaagccgatcaccggcaaggcgccatggcggtcggccgccgcgccggcaaagggctgcgccagcccccaggccagattgtgcagggcgatagcaaaggcgaccagggtgacgggcaccccgcgatcataggaaaacggcccgaggaacaggccgaatgtctggcgggttcccatggcggcgctcatgatcagcgccgccgacaccaccgccagaatcatcgtgcggcgccgtgtgtcgtttgtcttcatctcgacctccatcctgaaccctcagaatggaaagcggccatgacggcggcaaacgagaagccttcgcggatggatgaggactcctcatctatccggcagagtccacctgggcgatcagccagcgcttgaaattgcggagatcgggccggtgctcgacggcatcggaacagaccagccagtaggcggattcggtggcggcaacctccggccccacctccaccaacgagccgtcggccagttcgaggtctaccagaggcttgcgccccagcgccacccccagcccggcccgggcggcctcgaaggccaactggatggcatcgatgcgaatgccgccggcgaggtccagcccccgtgtccccgtggcgtcggcccaggcggaccagtcctcgctgaccgagaccacatggatcagcgtcgcgccacaaagccccggacctcccccggcggcggacaggctcgcggcataggcgggcgagcagaccggaaccaatcgctccgagaacagccgcgtccaggccgccccggccaaaggaatacggctcatgcggatggcgaagtcgaatccgtccaccggaaaactgacctgacggtgagaggtgtcgacggagacggacagctggggccagcgccggctgaattcgggaagccgcggcaggagccagcgcgaggcgatagtcggggcgcaactcaccgagatgccccgctctcccggaccgcccggcaggcgctgcgttccaatggcgatcagcgacagagcctcggagatatagggcaggtagccctccccctccggggtcagcgacaggcttcgggtctcgcggacgaacaacgcgacgcccagcgccttttccagcgccacgataccgtggctgaccgcgctggccgtgacgttcagctcctgggcggcgcgcttgaaactccgatgccttccggccgcttcgaagaagcgaagcgaggaaagggggggcaggcgaaacggcatgatggcctctcctccgatccccagagcctaccgggcaacccgggcggcatcaaccggccgacaccaccgtatggcgcggcgggacagcaaggaccgccgctcttgcgggaaaatcagcgcgagcccaaccaagcagccggacgcaactgcgcttttcacacacctttggtggtgatactgtgttggacataacagatgagaacgatcatatgttcacctgattccggaaggaggcaaaatgtcttcaatcctgcaacagattggaacaccccttcagctcattgccctgttcctctttctcgtcgctggaattgtccggctgatagtgaaaacaggccgactgaattttgcccccgcaaccacgcatctgattataaatcgcatctttcaggcggccgtattgtcgctcttgctaggaacgggaggaccggccgttgctccgcttgccgaccgcctgatcaacggcgaggacgaagtcctccacggcgccgttctgtccacaaccggagaggcgatccccggcgcgacggttaacctgctgacgttagccacagagccgaccaacactctggggcaatttactataacagtcccgagaaaccgcaagctcaatgaatacaagattcaagttacggcgccaggctaccaaacaccagacatcattaccgtaaagccatccgacgcaaaaaatatagaaattagaatttcaagggaaattcagaaaatcataaaatccaccacaccggatattatgattgggcaattccacggatcaccaatcattattgcgtcgatgcgcattgagaactcagggacgacactcgtccaaatcagcgacatgacagccaagttgaacgatgggacggcatcccttaccttagtgccaatgggctggacaataatcagtcagttcgggcagttcatgccaataacaggaccactccccatcaacccaggggtaaaaatagatcttcgcatactgatggccacaaacatcaatttttcaaatatgtcctctaaattggcaagtcttccagaatatcaatcgcaagcaccatgtgctcccggcttcaatggataccccacaccgttgactgacagagcctttactatcgtgagagactttgcccacgaacgcttcgcatggcatgacggtgactggacgttccaacttgataccgcggtcgatgggcaaaagcaggcctttgagagaaaattctccctcaccagcagcgaagtcatgcaattgcgcacctcaattggcctgctgaggcagtgccagcccgcgaacatagcgatcccccttgcccaagatggcaacattgccaatttcttgttcaaataggcctcctgcctcccttgcctgcggaggcgccgctatcgcgacacgacgggcgcaacgctcgttccggacacgcgccccgccaaagcgggggccgtatgagccaagccgcgttggccgtcaaaacactgacgcattgcaaaacagcagccagcgcccattaaggcaccgcgctaaccgcttgttttttcgggggaatggtgccggcgagaagactcgaactcccgacccgcgcattacgaatgcgctgctctaccaactgagctacgccggcccattgctgcgaccggcatcgagagcgcggtcgcgggccggaaagtagcgctgtgccgacggatttgcaagagcctgtcgccacacctttgccgcggtcaggcgtgcaccggcagaatggcgaagcgggccatggcgccgcgctcgatggccgcggccgccagacggtcgatgtccaggcgatggcggaacagttccagcaggcgcatgacctcgcggtgggggtcgcggtcggcggcggccacgtcgcaggccagggcataggcggtctcacgcaagcgcggcggcagcgatgccttgatcacgtccaggatacggttcaggccgtcgtcggaatcgagaatttcggcgcaggccgccgtggtccgcgtcagcagctccggatcgtaatcccgaaagatgggcaggaaattgacgatctcgccgatcatgcgcaattccggatcggtcatgttgccatccgcggcggaaaccatgaccatgacgtaaataagggccgcgtggtgactgatcatcatggtgctctcccgcgccaagccttgaactggactttacccttgcggcgcggcaaggcgtcaagcatagatttgtaggatccttgaggcatcgccggagtaaattcatgtcgggccgcaccgtgctattggtcgatgacagccgtgtcgcccgtatgatgacgcgttcggtggtggaaagcgcctgtcccgactgggtcatctgggaagcctcctcgggcgaggaggcgttggacctggccttgacgacacctcccgatttcgtcctgctggacgtcaacatgcccggcatgggcgggctggaggcggcccggcaattccgcgccagatttcccgcggtggcggtttccctgctgaccgccaacatccaggattccatccgcgacgaagcctcccagcttcagatcgggtacatctccaagcccttgcgggacgatctgctgatccggttcctgaccggcgggacgccggcgccatgacggaattgatcggcgcgctggagcgcgatgccgtcggagagatcctgaacgtcgccatcggccaggcggcggcgtcgctgtcgcggatggtcggcgaccgggtggccctgtccgtccccttcgttgaattcctgccgccggccgaggcggccgagcgcctggacgccaccacgggcggcgccgattcggtggcggtgcgccagcatttctccagcagtttttccggcgacatcctgctgatcttcccggaaaagcgcagcctggacctggtgcggtccatgctgggcgattcggtgcccatggactcgctcaccgagttggagcaggaggcgttgctggaggtgggcaacgtcatcctcaatgcctgcctgggcagcctggccaaccagctgggtctcgtcatcgaaagctcgctgcccatctatctgcgcggccgcggcgcccgcatccttgacgccaagcacccggacaccgagctggtgatgttcctgagggtggatttctccctgaccgccaagggcgtccagggccatctcgccttcgtcatggacatcgtctcggcgcggcacttcgccgatgcggtctccgcctatgtggcgcgcgtggtcgggagatagcccccagatgacgatctcggccagcgacaccttcctgcgttccctgaccgatgccacggagatgggcgtcatcctgctcgacgacgaaggccgcgtgaccctttggaacgcctggctggtggaatcgtcgggcatccgggcacgcgacgccatggggcgcaccatcgcggagctgtttccctccctggccgacggccgcgtcgccgaggccgtcgagcagaccctggcgaacggcctgtcggccatgctgtcgtcgtcgctcaaccgcatgctgttcccgctgacgcggaagggatcacgccccgaccggcgcgaaaccatgcaccagatcgtggtgatcaagccgctggatgccgacggacggcgcactggcctgatccagatcttcgacgtcaccagcatggcatcgcgggagaccctgctgcgccagcaggcccgcaccatggaggcgctggccgagaattaccggctgtcggagctgcataaccgggccatcgtcgacaacaccgccgacgccatcgtgaccttcggcgaggacgggggcatcggcacctacaacccgtcggcggaacgcatcttcggctatgccccgccggaaatcgtcggcaagcagatctcgctgctgatccccgagctgataaagcccgatcccttcctggaccaccgcaccgaggtggtcggcgtgcgcaagacccgcgcccacttcccgctggagctgtcgctggcctccatggaactgggcggccagcggctctatgtcgccatcggccacgacatcacgctccgcaaggccaacgaggccgagctggtgaatcagaaggagtggctgaccaccctgatcaacgccctgcctgacctgatctgcttcaaggacggcaaggggcgctggctggtggccaaccagttctacctggatctggtggggctgtcgggggtggattacgtcgggcgcaccggcccggaactggcgcgcctgtcgcacaatttccaggaattcctgaccacggccaaggagaccgacgagcgggcctggaaggacggcaagccgctcagctacgaaaaggccatggaaaccccgtcgcggggcaccaaggtcttcgacatgctgaagatccccctgttcaagccggatggccgccgcagcggtctggtcctggtcggccgcgacgtcaccgaacgcaagctggccgccgcccgcatccagcatctggcccaccacgacgccctgaccgagctgcccaaccgcgtcctgttccaggaacgcctgcgccagagcctggcccaggccaagcggtccgggtggaagctggcgctgatgttcctcgatctcgacaagttcaaggacatcaacgacacgctgggccaccatgtgggcgacctgctgctgcgcgccgtggccaagcgcctgacccgctgcgtgcgcgagaccgacacggtggcgcgcctcggcggcgatgaattcgcggtgatcctgaccaatctcgacgatctggaaggcgcctcgcgggtggcggaaagcatcatcgccggcatcgccgatcccttcggcctggacgagcacgaggtcaggaccagcacctccatcggcatcaccctgtatcccgacgattccatcgacgccgaccagttgctgaagaatgccgatctggccatgttccgctccaaggccgaggggcggaacaattatcacttctacgtggcgcagatggatgccgaggtccgcgcccgcaagctgatcgagaacgatctgcgccaggcgctgggcaccgagcagcttgagctgcactaccagccgctggtggagatgagctcgcgccgcatcgtcggctgcgaggccctgctgcgctggaaccacccgacgcggggctgggtgccgcccggcgagttcatccccatcatcgagcgctcggacctgatcggccctctcggccgctggattctgcaccgcgcctgccagcagggccgcgagtggcagagggacgggctggaacccatgaagatcgccgtcaacctgtcgccggcccagttcaagcagacccagagcatcatcgccatggtggccgacatcctggaccagaccggcttcgcccccgaccagctgcagttggagatcaccgagggcatcgccatgcagaatgtggatgccaccatcgaggtgctgcaaagcctgcgcgccatgggcgtggtgatctccatcgacgatttcggcaccggctattcgtcgctgaactacctgaagcgcttccccgtggacaagctgaagatcgaccgctccttcgtggtggatatcggcctgcatcccgacaacgccgccgtggtggaagccatcgtcaatctcggccactcgctgcgcacccgggtcaacgtggaaggcatcgagaccaaggagcagttggacttcctccaggcccacaaggtggacgaggcccagggcttctatttcagcaaggcggtccccgccgaccagttcgcccatctggtccgcaccaagagcccgtggcccgcatagcccttttttcttggataaatcaaagggaggcttggaggcatcgcctccaaccggggaccggggcgggagccccggggaagggccgcctcactcccccttgtggctcagcgcctttctgaggcgccgcacccccagccagacggcggcggccaccaccggcaggccgatcagcccggccaggtcgtaatccaccggcaggccgacggatttcagccccttggccagatagccgatcaggcccagcaggtaatagctgatggccaccacggacaggccctccaccgtctcctgcaaccgcaattgcagctcggcgcggcggttcatggagttcagcaggtcgcggttcttctcttccagggcgatgtccacccgggtgcgcagcagatcaccggcccgcgacacccgggtggccagcaattgctggcgctcggagactgattcgcaggtcttcatggcgggacccaggcgccggtcgacgaattcggcgaaggtctgcaggccgggaatgcggtcttcgcgcaattcctcgatgcggcggcagacgatggcgtaataggccttggccgccgacatgcggaagctggtggcggcatccaggcgctcggcctcggcggccagccgggtgagatgctccagcaggtcgcggtcgttctgctgcaccgccgggtcggccagctggctgacgatgccggccagctcgcggtcgatgcgggccacctcgggcgccgactggcgcgccaggggaaaggccagcagcgccatcatgcgataggtctcgatctccagcagccgctggacgaggcgtccggtctggccccgcgtcaggccgcaatccttgagcacgacgcgggaaaagccgtcggcgtgcaggcggaaatcggtccaggcctcgcccgccccccacagcaccttggcgcccaccagggtgttgccgtcgaacagcggccccagatcgtcgggcaattccttggtcaccagcacgtggacggcggtcatggcctcgcccggcatggtctccagccaggacgccggcagcatgtccagcgccgtatgggcgaatccgtcgtcgaacggatcgaagcgcatcaccgtataggtggagaattcggaatgccgctcccagcgcaggcgaaagccgcccaggtcgcggatgaagtatccggcgccgtcgccgggcggctcggccccgtgggaggccagcaattgggtgagatgctcgcgctcgtcggcgggattggcccccaccatggccagttgcgaggcccgcaccggggcggacaacagctcgtagggccgggcgtggacctcgccggccaggcttcgccgctgggcgtgttcattgagccggattggcaagccttcggccattgcccatatgtctccgataagagatgctgcttcgtcaggtttacaccactcagcccctttccgtcaggagcctttatgtccaacctcgccgtggcccaggatctgttcttcacccaaaccggcctcgacgcggatggattgcgccgcatcgtcgccgaggcgctgacgggcgccgatgacggcgaactgttcctggaataccgccagtcggaatccctggtcctcgacgacgggcagatcaagagcgccagcttcgacaccacccagggcttcggcctgcgcgcggtggcgggcgaggcccacggctacgcccatggctcggacctgtcggccgaggccatccgccgcgcctcggccacggtgcgcgccgtgcgctcgggccattcgggcaccatggcccaggccccggccggcggcgccaagccgctttacaccggaatcaaccccctggcccaggtccccttcgaggacaaggtgcggctgctggaggagatcgattcctacacccgttcccgggacaaccgggtgcggcaggtgaccgcctcgctggccgggtcgtggcaggcggtgaccatcctgcgggccgacggcaccctggccgccgacatccgccccatggtgcgcctgggcgtcaacgtggtgctgggcgacggcgaccgcatggagaccggcggccacggcatgggcgggcgcatcggctatggcggcgtcatgggcctcgccgactggcagcattgcgccgacgaggcgctgcgccaggcctcggtcaatctgggctcgatccccgccccggccggcgagatgccggtggtactggggccgggctggcccggcgtcatgctgcacgaagcggtgggtcacgggctggaaggcgacttcaaccgcaaggccacctcagccttcaccggcaagatcggcacccgcgtcgcctcgcctggcgtcacggtgatcgatgacggcaccattcccgaccggcgtggctcgctgtccatcgacgacgagggcacgccgacctcgcgcaccgtgctgatcgaggacggcatcctggtgggctaccttcaggaccgcatgaacgcccgcctgatgggggtggccgccaccggcaacggccggcggcaatcctatgcccacgcccccattccgcgcatgaccaacaccttcatgatggcgggagacaaggacccggccgagatcatcgcctcggtgccgcgcgggatctacgccgtcaatttcggcggcggacaggtggacatcaccaacggcaagttcgtcttctcggcctccgaggcctatctcatcgagaacggcaaggtcggcccggcggtcaagggcgccaccctgatcggcaacggccccgacgccatgacccgcgtcaccatgatcggcaccgacctggcgctggaccccggcatcggcacctgtggcaaggacggccagggcgtgccggtgggcgtgggacagccgacgctgcgcatggacggcctgacggtgggtggaacggccgtgtgatccgccggacggcgcccggcgcccctccgcgagccgcctaaaaagcgcaccccaccttcgtcatagcatgacgatgcgagttgccctgggctgacgtataatgggcgacaactaaaacatcccccgccccagggggatctgatgtcgtccctgtcatttggagaaatcgccggtccattggccccttgtcttatccgtacgtcatgaccattccggccgttttccgagcagcgactccttttgaaggaggcgtaccatgcgaaacccactctcccgattctcgctcaagattcagatcggctctctggtcgccttggccgggctggttctgtcgaccctgttggccgtggacctgatggagcaatccatcgccgatcgcgccaacgccattgccgcacgggagacgatcatcggcgatcaggccggcgcggtggatcgtgcgctgctcaatgcccgccggcatgagaaggacttcctgctgcgcggcgaagccaagtacattgcccagcatgccgaatcgatccgcgccgcccgggccgccctggacggcatgacttcggccatggtcaccgacgatgtccggcatcctcagatcgacgccgtccgcaagggcctgaccacctatgtcgacgccttccgcgtcctgaccgaacggcacatcctggtcggcctgaccgtgaacgacggcctgacgggggctttgcgcaaatcggtccacgagatcgaaagtgcgctcaaatcccatgatgacccgccgcttgcggtcgccatgctgaccatccggcgcgacgagaaggacttcttcgcccgcctcgaccccaaatatctggacgagatggcgcagaactatgtggatttcgaaaaggcgctgtcggtgtcggccgttcccgcccgggatcgcccggcgatcctgaaccttctggccgactaccggcgtgatttcaccgccgccgccgaggcctccctggccatggtcggcgacggcacggttctggcctcgagctatgccagcgtccagccgctcatcgatgccctggacgacgaggccctgacggccatgaaggtcgccaaggaacgcgcccaccaggccgacgagaccgccggccggatgatgctctccgtcatggcgtccggcttcgccatcatggtggtgatcggcacgctgatcgcccgctccatctacggccccatcaccgccatgaccggggtgatgggcgaactggcgggcgacaatctgtcggtcacagtgcccttcaccgatcgcggcgacgagcttggcggcatggccaagtcggtggggcatttcaaggatcagctgatccgcgtccggcaactggaagccgcccaggaagagcagaagcgccgcgccgaggccgaccggctggccgccatgcgcaagctggccgataccttcgagggcagcgtcggcaaggtgatcgagaccgtcacttccgccgccaccgagctggaagcggcttcgggccagatggcgggcaccgccaccgagaccagcagccaggccaccaccgtggcgtcggcggcccagcaggcgtcgaccaatgtccagaccgtggcctcggccaccgaggaactggcttcctccatcaaggagatcgcccatcaggtcgaacggtcgcaggccgtgtcgcaccatgccggcgatgaggcccacaccaccaccatgcaggtccaggccctgtcggcgaatgtcggcaagatcggcgagatcgtcaaactgatcaacgacatcgcgtcgcagaccaacctgctggccttgaacgccaccatcgaggcggcccgggccggcgaggcgggcaagggctttgccgtggtggccggcgaggtcaaggatctggccaaccagacggccaaggccaccagcgaaatcgccggtcagatccaggcggtgcaggacagcacccgcgtcgccgtgcacgccatcgaaagcatctccaaggtaatcgccgaaatgggcgagatcagttccgccgtcgccgcggcggtggagcagcagaccgccgccacgggcgagatcgcccgcaatgtggaacaggccgccgagggcacccaggaggtgacccgaaacatcgtttcggtcgagcaggccgccaaggaaaccggccaggccgccgagcagattcgggaatcctcgggcgagctgtcccggcaggccgagttcctgcgtcatgaagtcgggcagttcctgatccaggtccgctccgagaagaaggatatggtcctgctgcattgggatcgcgacctggaggccggcgtgacctccatcgaccgctatcaccaggaaaaattcgagcacatcaatgagttctatcgccagatgatgtccgaggacggcggcaaggcggccatcgccctgctgtccgagatcgaccggtccatccaggggcatttcggcgaggaagaagccctgatggcgaagtgcggctatggcgacggcgaagcccatcgccgcagccacaaggccttccaggagcgaattcgcgccctgagaaccggcatcgagaccaaccaccccgaggccgtgtcccaattgttcgactacgtctcggactggttccccgaccatatccgcaacgaagacatggccctcgccctgttcctgcgggacaggaagatggccgcctgaagtgagaggcccgatggggcgcgatgacggtcgcgccccgtcggctaaggttcagacactaacccttcaggcgaagaaccacttgtaaatggccgttgtttttttaacttctcatatacgcatgcccaggtgcccataagtttttcatggaataatctgtgcgggtaaagaggggggagcgcgccattggcggttccccctttattgtccgagaaggttgtccttatggtaaaaaacggccctaatgaaggcccctgtggctgggaaaagcgttgctcgcccctggatgtcgatgagttgcaccacgtgctcaactgcgcctcggggcgagggtgcaatcaatgcgtgaagtgtagcgagctggccctggagcagatcctgcaccaagcccgcaaaagcggtcgcggcgtgctcaccgggctcgagcggcttgagaacgacatggaattcgccggcgccttcggtctatagccccgccgccatcaggcctcgcagcctgtccaggcattgggaacggtcaggacggtaatccaggtcttcccaccacgcctccaccgcggccagaaggctgccgatccgcggtccgtgcggaacccccaattccagcagatcacgccccttgaccggcaactccaccggctgccagtcgcgggcggcatcgagcaaggccgtccagcaccgggactcggcggcatcggggcgcgcctcggtcgagcgccgcgcagcccaggccaccatcaccagatcacggaactcgtcgccgcccaccttgcgcaaggcccgccgggtggcgggaccgtccatggcgaaacccacgtggacccgcggcgccgccatggcggccacccgcttggcctgcacccccgacagcttgagacgctcgcccaggtccagggctccggcccggtcggtggccagcagggcggccaggcggcgcatggaatcgggacggatctcgggccgggccagtccgcgacgctccagccaggccagggtccgcagccgcccgaactccttcgcctccggcaggatgtgcgccaggatgccgtggctgtgcatgaccagcagggacggcgtggggtcgtcggccagcagcaggcggaccagctcccccgccacccgctcgcccgacaggcccttcagccggtcggccatgcggcggcaggcgttgagcgcccgggtctccatggcgatgccgcggccgtaatgggcatggaagcggaagaagcgcagcaggcgcagcgcatcctcctcgatgcgcttttccggctcgcccacgaagcgcacccggcccgccgccatatcggcgatgccgtcaaaggggtcgtagacgttgccttcgggatcggccgacagggcgttcatggtgaagtcgcgccgcgacgcatcggcccgccagtcgtcggtgtattcgatgcgggcgtggcggccgaagctctccacgtcgaccctgagcgtggtgatctcgtaatgggccttgccgatcaccgccgtcaccgtgccgtggtcgatgccggtgggaatggcatgaatccccgcatcgtccagcagggccagcacccgctcgggcgggtcgggggtggcgatgtccacatccttgatgggacgcttcagcagggcgtcgcgcacgcagccgccgacgaagcgcacccgggccccctcggcctgcagcgccgccaccacggcgcgggtctcggcggcgtccatccagtcctgcggccccagtaggccgatgggatcaccgggattgaggtgaaggcgggtgttactcatgccggaccaccgatgtcattccgacgaccatcgggaggaggaatctcattctgaaccggcggttccgtcgcgggaacggcgcgccaagcggagatccctcgcctacgctcgggatgacggtcatggtcattccgaggtcctgccggtttcgcgaggaaccagcacttccgacaggttgaccaggattccggcggtggcgccccagatcagccggtcttcccaggtcagcgcccagaacggccgctggaagcccctgacttcgcggctttgaagctggtggttggcctggtccagcacgaaggccagcggcacctcgaacacctcggccacctcgaaggaatcgggggccagcgtgaagggcggatcgatgacgccgaccagcggcgtaatgatgaagccggtcccggtggcgtagtcgtccagacggcccagcaggcggaccagatggcgggacaggccggtctcctcctcggtttcgcgcaaggcgcaggtggcgaagtcgccctggtcctcgggttcgagccgcccgccgggaaagctgatctggccgggatggtgggcgagatgggcggtgcgcttggtcagcatcacggtcaggccctcggcgcgctccaccagcggcaccaggacggcggccggcgtcaggctgtcatcggtggtggcggtgccggggcgcacggcgccgccctggaccatggcctccagggccgagtccgagcgcccgcccgggtcgaacccgtcggtcagccgtcgcgcgatcacctcgcgcgtcagtcgggaaggtccagcctccccaatggaaaaaagctcccgctgctccataggccgtaaaccgcttctccctcccggtcctcctcccacccttgagcgaccagttcgtaatagacggagcgggtgaggcgcgcctcgatcccgttccgcacggtgacgtagggcgacggctcccccgagccctccccttcggcaattctcaacggatggtcggcgtcgacggtgaccatctcgtccatattggtgcgaaagctgaccaccatgtcgcggccgccaccgcaggtgaacatctcgaccgccaggaagggaacatcctccacctcgatgcggcccatttcgcccggtgtgatcagcagatagccgccgtccttggaccggtacagcaccgaggcgaacaggcagaccatctctttgcggttgatcggcgagccatggtagaaccaacgtccctgccggtcgatgcggataccgagatcaccgcaatactcgggcagttcgcccgggtaatccacatccgggggggattcggtcaaaggctggttcaatcggccgctcctgagcattcttctcctgcgaggcgccaattccatgacaccgcacaccagttccgccgccccgcaagacgagatcgccgccctcgaatcccgcctgtccgaggcccgcgccgccatcggccgcgtgatcttcggccaggacgaagtcatcgatcagagtcttatcacgctgctggcggggggtcacgccctgttgatcgggctgcccggcctggccaagacccggctggtccacaccctgggcatcgtgctgggcctggacgacaagcgggtgcagttcacccccgatttgatgcccgccgatatcctgggctccgaggtgctggaagagggcgccggcggtgcgcgcgccttccgcttcatccaggggccggtattctgccagctgctgatggccgacgagatcaaccgcgccgggccgcgcacccaatcggccctgctgcaggccatgcaggagcaccacgtcagcgtggcgggcgcccgccaggacctgccccggccgttccacgtcctggccacccagaacccgctggagcaggagggcacctaccccctgcccgaagcgcagctcgaccgtttcctcatgcagatcgacgtgggctatcccgaccgtgacgccgagcgccgcatgctgatcgacaccaccggcgccgtctcggccgaggcggaacgggtcatgggcgccgacgacctgctggcggcccaggccctggtccggcgcatcccggtgggcgatgcggtggtggatgccatcctcaacctggtgcgccagggccgcccggaaagcacgtcgctggatctggtccgccgggcggtggcctgggggccgggcccccgcgccgcccaggcgctgatgctggccgtccgggcccgcgccctgctccagggccgcctgtcgccatcggtggacgacatccgcgccctggccgcgccggtgctgcgccatcgcatggcgctgggctttgccgcccgggccgacggcatcaccctggcccaggtgatcgaggccctggacggcaccctatgacggacggctccgtcctttctttcgacgccgaccagcggcagcgccgggccgccgaccccaccgccagcgtctgggtggcggccagcgccggcaccggcaagaccaaggtactgaccgaccgggtgctgaccctgctgctggccggcaccccgcctcacaagattctctgcctgaccttcaccaaggccgccgccgccgagatgtccaaccgcatcgccgggcggctgggccagtgggccacggcccatgacagcgacctggccgacgacctggggagattgctgggccgggcgccgtccccgggcgagatgacgggggcgcgccgcctgttcgccgccctgctggacgcgccgggcggcatgcacatggagaccatccacgctttctgccagtcgctgttgcgccgctttcccctggaggcaggcatcgcgccccatttccaggtgatggacgaccgcgacgccggcgagctgctggaggccgccaagctggaaattctttcccaggcccgcatgggcgacggcgccctggggggcgccctggccctggtgacctcccgcgtgcatgaaaccgcctttcccgaactgatgggcgaactgaccgccgagcgcgggcggctggagcgtctgttcgagcgccatggcggagtcgagggcgccctggcggcgctgcggacccggctggggctggaggcgggcgacaccccggactcgctgctggcctgggccaccgatgaggcccatttccagggcgaaggcctgcgggaagccgtggcggcgttgctgaccggctcggactccgaccgcaagcggggcgaggccatggcccgctggctggccgatccggcggggcgggaaaatggctttgccggctggtgcgcccagttcctgaccgccgagggaggcatccgcaagaccctggccaccaaggcggtgcgcgagggctttcccggcgtcgaggattgcctgctggccgaggccgagcgcctgtatcgcctgaccgagaggctgcgggccgcccgcatcgccgaggccacgggggcgctgctgactctgggcggcgccctgctcgcctcgtatcgccgcgccaagacccatcgcgccctgatggattacgacgacctgatcctgggcgcccgcgacctgctggcccggccgggtgtggcgccctgggtgctgtacaagctggacggcggcatcgaccacgtgctgatcgacgaggcgcaggacaccaatcccgaccagtgggcggtggtggagaagctgaccgaggaattcttcgccgggcgcggcgcccgcgaaacgttgcgcaccgtcttcgcggtgggcgatgccaagcaatccatctactcgttccagcgggccgacccgcgcgaattcgagcgcatgcgcgaggccttcgccacccatgtgcccgccgccggcggcaagtgggaggtggtcgacctcaacctgtcgttccgctcggctcccgccgtgctggaggcggtcaacgccgtcttcgcgccgggacggccgggccgcgacggagtggccggggacgaggacatcacccacctgccccaccgcggcggccaggccggacgggtggaggtctggcccgtcgtcgagccccgccccgccgacgagcttcccgcctggaagccgccggtggaacgcatcagaggcgattcgccgcgcacccggctggcccggctgatggcggcgcgcatccgcgccatgatcgacggcgaggtcctggagtccaagggccgtccggtgcgggccggcgacgtgctggtgctggtgcgccgccggggcggcttcgtcgaggatctggtgcgcgaactgaaaagccgcaaggtggaggtggccggcgccgaccgcatggtgctgaccgagcagatggcagtcatggacctgatggcgctgggcaatttcctgttgctgcccgaggacgacctgacgctcgccaccgtgctgaaggggccgctggtggggctcggcgaagaccagcttttcaccctggcccatcatcgcggcaaggatgtggggctgtgggaggccctgcgccagggcgtcgccgacgagggcggcgtgttcgaggcggccttccgccggctctcggagctgctggcccaggccgaccgcgtctcgccccataccctctatgcccgggtgctggggccgctgggcgggcgccggcgcctgctggcccggctggggctggaggccgaggattccatcgacgagttcatgtccctgaccctggccttcgagcgcgcccacccgccctcgcttcagggcttcctccactggctggaggcgggcgccctggagatcaagcgcgacctggagcaggcgggccgcgacgcggtgcgcatcatgaccgtgcatggctccaagggcctgcaggcgcccatcgtcttcctgcccgacaccatgcaggtgcccacccgctcgccccgcctgctgtggctgggcgagggcgagggcgaactccccgcctggccgccccgggccgaggacatggattccgtgtgccgccagggcgccgacgcacgcaagcaatcgcgggagcgggaataccgccgcctgctctacgtggccatgaccagggccgaggaccggctggtggtctgcggctggcgcggcctgaaggcggcgcccgagacctgctggcacgccctggtccagtgcgccctggcccccaccgccgccgccttcgacgatcccttcctggccaaggcggccgagaccgccgaaggcccggtgctggtcctggccaatgcccagaccgcgccgccggaaaaggaaaagggcgccgggccgggagcggggcaatcctcgccgctgcccgactgggcgctgctctccgccgaaccggagcccatccccccccggccgctggccccgtcgcggcccgagggcgaggagccgaccgtacgctcgcctctggccgagatggacggcaagccgcgctggcagcggggcaagctgatacaccgcctgttgcagaccgtgcccgacctgccgccccccgaccgctcgcgcgccatgttgcgctttctcgcccgcccggcctggggcctggaaacgcccgagcaactggccatcgccaacgaggtctccgacatcctcgaccatcccgggctggccgggctgttcgctcccggctccagggccgaggtgccgctggtcggacgcatcggcgaccgggtggtctcgggccgcgtcgaccggctggcggtcagcgacaccgaggtggtgatcgccgattacaagaccaatcgccgcccccccgccacgcccgacgaggtgcccgagctttacgtccgccagatggccgcctaccgcctggccctggcctgcatctatcccagccatcgggtgcgttgcgtgctggtgtggaccgacggccccctgctgaccgagattccctccgcccgcctggacgacgccctggccggactggtggaataaccacactttccccttcccaaaactgaactggttggtttagttttgcggctggaggtgccatgacccaaacccggacccggtccaaaccctcggccaagcgcgaggccatcctcgacgcggcccagcgcctgttcctggtggaaggctatgccgccaccagcatggacgctgtagcggccggggcgggcgtgtccaaggccaccatctacgcccatttcgagggcaaggatcagctgttcgccgccatcatgcaccgccggtgcgaagcatccttcgtcttcgcctcgccggacgagagcttcgacgcggtgcggaccttcaccacctatgccgagcgcctgctcaccctgctgatgacccccgacgcactggctctttaccgggttgtggtcgcggaatccgcccgcaccccggaactggcccaggcgttctatgacaccggccccacaagaggcaagacggccatttcggcctcggtggtcaggttgcaggaacggggcgaactggtggccgaggtcgaccccctggtcattgccgaccagttcatcggcatgctgcgggctgaaacataccaccgtgccctgcttggcctgccctctggccgttccatcggagacacggtggcccatgcggtgcagacgctgatccgcgcctacggcaaacggtagaaccccctatttccttcgtgatgcgatccatcctccaacggatagcgcgtcacaatattgttgttacaaacaacagttatatgtaacaacatatgcaacgatgtcgcccggatcaaccggacggaccgaagagaacaaacgggaatcaggcttcatggccccgccggaccaccggcgtggcgagggaggagtcatgcgtctggcagatgtgagaatcggcgtgcgtctgttcgccggattcgggctgatgatcatcatcaccggggcgctggggctgttctccagcctgcaattgcgttccatttcggcccataccgagttgctgtaccgccaccccttcacggtctcgacggccctgtccgaggccgatggcggcatcatcgccatgcaccgggccatgaaggatctggcgctggccttcgaggacagcgatatcgccaaggccgaagcggccatcgatgcggcggaaagccgggtcgtgaagaaactcgacacggcgcgcgagcgctttttggccgaccgggcggtcttcgaccagctgggcaaggctctggcggcgtggaagcccattcgcgccgagatcgtcgagatgatgaagcagggccgcagcgtcgaggccgccgacttgaccaagggcgccgccgccaagcaggcggaggagatccagaccctgatggcctcggccatctccctggcggccgaggatgccgcgcgcttccgcgagaaggcggaaagcgagcaagtgagtgccgggctctccctgctggtgtccttccttgccttcgcggtcgccggcctggggctggccctgctggtcacccgctcgctgacccggccgctcgaagccctgcgcacctgcatggcgagcatggccaccggcgattacgaggtggcggtgcccggcggcgaacgcaaggacgagatcggcgccatggcccgcaccctgaacgtcttcgccgagaatggccggcagatggggcggctggccgaggaccgccgcgaggctgaccgccgcgcctcggtggaacgccgcgaatcccgcctggccctggccgctgaattcgaggagaaggtcaccgccgtcatggggcgcctgtccgaggccgccgccgagatgagccatgccgcccaatccatgtccggcgtggccgccgacgcctccggccaggccagttcggcggagagcgccgccgataccgcttcggccaatgtgcgcaatgtggccgaggcggccgacgaactgtcccactccatcgccgccatcgagcgccaggtggccgcctcttcgtccaccaccgccgaagcggtgggcaaggccgagcgcgcttcggccaacgtggccggactggccacagccgccgagcgcatcggccaggtggtggacctcattacctccatcgccaagcagaccaatcttctggccctgaacgccaccatcgaagccgctcgtgccggggaggccggcaagggcttcgccgtggtggccagcgaggtcaagaatctggccaaccagaccgccggcgccaccgacgagatctccacccagatcgcccaggtccagtcggcgaccggcgaggcggtggcggccatcggcgatatcgtgcggatcatcggcgacatcagcgccgccgtgggctccatcacccaggccgtcgccgagcagcaaagcaccacccggcgcatctccgacagcgtcagcgccgcggtgggcggcaccgaggaggtggtgggcagcgtcggccgcgtggccgccgccgccgcccaggcaggcgatgccgcctccctggtgctgggccagtcgaacggcgtcgcccgacgcaccgacgacctgatgggcgaggtggaagccttcatcgaggggataagggccgggtagaaccggcggcccgttcggaaggaattgataagcgtcaagcggcacgacgcacagcatcgcccaggcccgtcacggcctgggcgatgccgttttcacggtcggcgcatcgtgactaaaatcaatatagaaccagtaagatttacgaccttcattgtcgttgcgcttaacgattattgacatttgtcatttgatgaatgtcaaattattatcgtttacttgattcaatcccacacagagattacggtctcccccgccggaattgccggtgattttgacttgcccaggggaaaccgatgaaggcagcgacttggatgatggcggcactggcggtcgcctgggccgggacggccatggcggaagagaaacccgcccatggcgccggcgagcattatgaaaccagcggcgaccagctccgcgccgcccccatgagccagccgggcgcccagcccggaccgcagttgagcgcggccgaattcaccagggcaaagcagatctatttcgagcgctgcgccggctgtcacggcgtgctgcgcaagggcgccaccggcaagcccctgaccaccgacatcacccgcgagcgcggtttcgacgcgctgaaggccttcatcacctacggctcggcggcgggcatgcccaactggggctcttcgggccagttgtccgaggccgaggtggacctgatggccaaatacctgctgaacgagccgccgcagccgccggaattcggcatggacgagatcaaggccacctggaaggttcagattccggcggacaagcgtccggccaggaagatgaacaccctggacctgtccaacctgttctcggtgacgctgcgcgattcgggcgagatcgccctgatcgacggcgcgtccaagaatatcgtcagcatcatcaagaccggctacgccgtccacatctcgcgcatttccgcctcgggccgctatctctacgtcatcggccgcgacgccaagatcaacctgatcgacctgtggatggaaaagcccgagacggtggccgaggtgaagatcggcatggaggcccgctcggtggagacctccaagttcaagggcttcgaggacaagtacgccatcgccggcgcctattggccgccccagttcgtcatcatggacggcaatacgctggagccgaagaagatcgtctcgacccgcggcatgacctccgacaagcaggaataccaccccgagccccgcgtcgcgtccatcgtcgcctcgcacttcaagccggaattcgtggtcaacgtcaaggaaaccggcctgatcctgctggtggactactccgacatcaagaacctgaaggtcacctccatcgaggccgagcggttcttgcatgacggcggcttcgacgcctccaagcgctacttcctggtggccgccaacgcccgcaacaagatcgccgtggtcgataccaaggaagacaagctggtgggcatggtcgaggtgggcgccactccccatccgggccgcggcaccaacttcgtccatcccaagttcggccccgtctgggccaccggacacctgggcgacgacagcgtggcgctgatcggcaccgatcccaagggccatcccaagcaggcctggaccaaggtggcctcgctgaccggccagggcggcggttcgttgttcctgaagacccaccccaagtccaagaacctgtgggtcgacaccacgcttaaccccgacgccgacgtggcggcctccatcgccgtgttcgacatcaacaacctggacaagcccgccgaggtgctgcccatcgccaagtgggccggcatttccgacggcgcgccgcgcgtcgttcagccggaatacaacaaggccggcgacgaggtgtggatctcggtgtggaacgccaaggacaaggtctcggccatcgtggtggtggacgacaagacccgcaagctgaagtcagtgatcaaggacccgcgtctgatcacgcccaccggcaagttcaacgtcaccaacactctgcacgacgtgtactgaattcccttgaatcgaagcggggcggctctccaaatgaggagagccgccctttgtcgctttcaggggagaagccgccatgtccgcctatctgatcgtcgatacccaattggacgatcccgagctgtacgaggagtacaagcacaaggcccggccgctgatcgagcggtggggcggcgaatatctggcgcggggcggaaccctgatccagcgcgagaccgacctgtggtcgcccacccgcatggtgctgatccgctttcccgacctggagaccgccagggcctgcctggactcccccgaataccaagccatcgtcggcctcagccaccgctcggcgcggcgcaccgtggtgatcctggaagggctgtgacctactctgcgccgctctgctgcttcatgcggaagggatggcggggatagacgcccaggatgcggacctcgtggctgaagaagtccagttcctccagggccagacgcagattgcgctgggtggggtggccttccacgtcggcgtagaactgggtggcggcgaattcgccgcccaccatgtagctttccagccgggtcatgttgatgccgttggtggcgaaaccgcccagcgccttgtacagcgcggcggccacgttgcgcacccggaacacgaaggtggtgacgcagggctggttgggattgggctccagcgcctcgcgggccaggaccacgaagcgggtggtgttgtgctcggcgtcctcgatccccgccttcagcgacaccaggccataggcctcggccgccagttccgaggcgatggccgccatggtggggtcctggcgctcggccagctcggccgccgcgccggcagtgtcggtgccgacgatgaccttgaggcccagttcgcggatcaggttgcggcactggcccagggcgtggacgtggcttttcaccgtcttgatggtgtcgagcgtcgcgccgggaaccaccagcaggtggtggctgatgcgctcgaaatgctcggcgatgatgtgcagcccggcatagggcatcaggtgatgcacgtcggcgacccggcccgccaccgaattgtcgatggggatcatggcatagcgggcgcggccctcgcgcacggcggcgaaggtgtcctcgaaggtggcgcagggcagcggctgcatgccgggataggcattgcggcaagccagatgggaataggcgccgggctcgccctggaaggcgatagcctgatcgggattgggctggtcgttcatgcgggactcaggctttcagcagggcacgcgcccgttcgaggtcggcgggagtatcgacacccagcggaaccgtgtcaaccaaggcgcaatcgatgcgcatgccattctccagcgcccgcaactgctccagcttctcgcggctttccagcacgccctggggcaggctgacgaagcgctcgagcgagtcccggcgataggcgtagagcccgatgtgatgatagtgcggccccgcattggccggcacggtggcgcggctgaaatagagcgcccggcccacgcgctggccgggacgcagccccaccaccgccttgaccacgttggggttggtgcgctcctcctcgttggtgatctcggtcaccagggtggcgacgtcgacccccggctcggccagaggcgcgaagacggcgcggatgatctgggggtccagggtgggaaggtcgccctgcacgttgacgatggcatcgaaccggccctcggggtcgagcttgcgcaccgcctcccacacccggtccgagccggacggatggtcggggtcggtcatcacagcctggccgccatgggcgtgcaccgcatcgaacacctcggcctccgagcaggccaccaccacggggccaagcccggcctgcaccgagcggcgccagacatggatgatcatcggctcgccatggatgtcggccaggggcttgcccggcagccgggtggcctgcatgcgggcgggaatgacgatgatgggggtgagttcggccatgggtgatccgtgtgtgtatcagctagttaatacgcaccctatccacatccgccatttcgcgccacactcgggcgcgtcgcaacggcacggaaacgacaaacatgaccgcctgtccctccgaattcatcgccctggccgagaaactggccgatgccgcccgcccggtcgtccggaaatacttccgcaccccggtggcggtggacgacaaggccgattccagcccggtgaccatcgccgaccgcgaggtggaagcggccatgcgcgccatcctggccgccgaggcgccctcccacggcatcctgggcgaggaacatgggcgcgagaattgcgacgccgaatacgtctgggtgctggaccccatcgacggcacggcggccttcatcaccggcaagcccagcttcggcaccctgatcagcctggcccgcaacggcacgcccatcctgggcctgatcgaccaggccttcaccaacgagcgctggctgggcgccctgggccgccccaccaccttgaatggccagccggccagggtgcgggcctgtcccgatctggcccatgcctacgccttcaccacggcgccggaattgttctgtgaagcgacccgtcccgcctgggaccgcatcgccgccgggtgcaagcgtccccgctacggctgcgactgctacgcctatgccctgctgtcctcggggttctgcgatctggtggtggaggcgggcctcaagccctacgacttcgccgccctggtgccggtggtcgagggagcgggaggaattatgactgactggtcaggtaagccactgaccatccattccgacggcaaggtctgcgcggcgggcgaccggcgtcttcatgcggaggcgctgggggttctcaaccgatgacccccaagcaggccgaccgcttctacgccctgctggccgagcgcaatcccgagcccaagagcgacctggaatacgccgatccctacaccctgctggtggcggtggtcctttcggcccaggccaccgatgccggggtcaacaaggcgacgcggccgctgttcgcccgggtcaacacgccccaggccatggtcgagctgggcgaggaggggctggtccaatccatccgcaccatcggcctgtacaagaccaaggcgaagaacgtcatcgagctgtcgcgccgcctgctcagccttcacggcgggcaggtaccccacgaccgcgcggcgctggaggccctgccgggggtcgggcgcaagaccgccaacgtggtgctgaacatcgctttcggcgagcccaccatcgccgtggacacccattgcttccgcgtcgccaaccgcaccggactggcgccgggcaagacggtggaggcggtggaacagggcctgatgaaggccaccccggccaaatggctgcagcacgcccaccactggctgatcctgcacggccgctatacctgcaaggcccgaaagccggactgtgccgcctgcgtggtgcgggagctttgcgcctttgacggcaaggagacggtttaggagccgtaagcacccgccacgtagggcttgaactccatgtcgctgttgacgatgtggctgaccagccaggtggccagggaatcgcccagggtgcgaacgatgccgctgcggacctcgtcgcagccatcggtgaaatgggccagcacggcgtccaggcgcttcatcagcatttcgtgggcggtgcggtgggattcggtttcgggaaagccgacggcatgctgcagggcttcctcgcgggcgaagtgttcgcggcacagatcggtcaggtcgcgaagcgtccggccgatcccggcacagtcgatttccagacccgcggccacctcaagccgggcaatcagctcgatcatccgccgatggtcggcatcgatgatcggatcgccgatcgccagcgcctcgttccaggcgattgacatcagacccctcccggtcgatacccgaactcccgtcccggactctacccgaggcgggcaaagggggaaagccggatgatggtcgtatctcacgtggtgctgggggtgtccgcctggaccctggcacagcgggcggggctggccgttcccctggggccggagggcgcggcggcggcggccctgggcgccctgctgcccgacatagaccatccgtcatcctggctcggccgccgcctgtggcccatctccaagccgatctccatggtgctgggccatcgcggcctgacccactccctgctggcggtcatgggcggtctggcggtgctgatgctggtggagccgggccggggactggtccgcctggccgagccgctggccctgggctatctctcccatctggcggccgatgccctgacgccggcgggcgtgccgctgctgtggccctggaagcagcgcttcggcgtggggctgtgctccaccgggggcgtgatggaatggctggtggtggcggcggtcgccgccgccacggccttcctgaccgggctgtcgcccggccccgtctggggctgacgccccttacagatggataagcgtcggcgccagccagcccagcaggccgaaggcgatgcccagcgcgcccagtccgcccgccacgaaggacagggccagcatgccggtgaccaccgaggccgaggccagcacgatggcgatctgcagggcggcggcgccgtattcgaacatgtgataggccgacagggccttgtcgcggcgggcttcctcgctcttggccttagcggccagttccttgcggccctcgccggtctcgggctcggaatcgtagcggctggcggtggcgcgccattcggccgccttcttggcgacgccgtccgacggcggggccgaaagctccagggcgtcggcggcggtgcgcagcgtggtcgagcggatatgcttggcctgatagaaggcccacaggtcgttggcgtggatattggccgacagcgaggtgttctgggcgctcttgccgccggcctcgatgatggccagcaaggcggcgagaacgctgatcagcaccgcgatcttcttgttgcggctggccttgccttccttgtgggcatgttcctcgtggtggtcgtggtgggcgacctcgtggatggtctcgtgcgtctcgtgggcttccatgaccggccttttttccgttaccttagggggcttcatatccgaattcggagtatcagagtatgttcatggtccagtgcaaggacaagcccggtcatcttcagacccgcctcgacaaccgcgccgcccatctggaatacgccaagaccttcctggacaagatgatcatcggcggcccgctgctgaccgatgacggccagggcatgatcggcagcgccttcgtgttcgacaccgacaaccgcgccgaggtggaggccttcctggccaacgacccctatgccaaggccggcctgttcgaaagcgtcagcgtcatccgctacaagaaggtcctgccctgatggccttctggcttgtcaagtccgagcccggcgcctggtcgtgggacgatcaggtgcgcgacggcgtgaccgcctggaccggggtgcgcaactatcaggcctgcaacaacctgaaggccatgaagctgggcgaccgggcgttcttctaccactcggtggacgaaaagcgcatcgtcggcgtggtcgaggtggtgcgcgaagcctatcccgaccccaccgccgaggacccgcgctggatgtgcccggacctcaaggcggtggcccccctggcccggccggtcaccctggccgagatcaaggccgatccccggctggccgagctgccgctgctgcgccagagccggctgtcggtctgcccggtggacgaggcctcgtggcggctgctgtgcgacctgggcggggtgacggcttgaagaccctctgcgcgctggagtccatccccgatcccggcgcccgcgagttccgcgccatggtcgatggcgagaagcgccgcgtcttcgtggtgcgccggggtgggcaggtcttcggctatgtcaattcctgcccgcatgtgggggcaccgctcaacctggaagacaacaagttcctggacctgttccaaacgtcgatcctgtgcgccaaccacttcgccctgttcgagatcgagagcggccgctgcacccgcggcccctgcaacggccagtcgctccaaccctttgctgtcgaaatccgcgacggacaggtcatgcaactggaatgattgcaattccatgatggcatggcacctacccctttgagcgggcttgtttcgtcatggcgagtcgaacataatcatcagcctgcttactggggaaacatcccgcgccagccaccaaatggacgcgggtcaatcagaaaagggagacacccccaagatgtccgaggtctatcctgtgcccgctgagaccgcgaagaacgctctcatcgacaacgacaagtacaatgaatggtatgagcgctcggtgaaggaccccgacgggttctggggcgagcacggcaagcgcatcgactggatcaagcccttcaccaaggtgaagaacgtttcctattccggcgacgtcagcatcaagtggttcgaggacggcacgctcaacgtgtcggccaactgcctggaccgccatctggccaagcgccgggaccagaccgccatcatctgggaaggcgacgaccccaacgaatccgcccatatcacctatggcgacctgcacgagcgcgtctgccgcctggccaatgccatgaccgatctgggcgtgaagaagggtgaccgcgtcaccatctatctgcccatgatccccgaggcggcggtggccatgctggcctgcgcccgcgtcggcgccgtgcattccatcgtgttcggcggcttctcgcccgacgccctggccggccgcatccaggattgcgattcctcgctgctgatcaccgccgacgagggtctgcgcggcggccgcaaggttccgctgaaggccaatgtggacaaggctctcgagacctgctggtcgtgcaagagcgtcatcgtcgtcaagcgcaccggcggcgacatccacatggtcacaggccgtgaccactggtaccacgacctggtggccaaggccgctccgacccacacccccgtggagatgagcgccgaggacccgctgttcctgctctacacctcgggctcgaccggcaagcccaagggcgtggtccacaccaccggcggctatctggtctatgcctccatgacccaccagtacgtcttcgactatcacgagggcgacatctactggtgcaccgccgatgtgggctgggtcaccggtcactcctacatcgtctatggtccgctggccaacggcgccatcaccctgatgttcgagggcattcccaactacccgaccgtgtcgcgcttctgggacgtggtggacaagcacaaggtcaacatcttctacaccgcgcccaccgccatccgctcgctgatgcgcgaaggcgaggagccggtgaagaagaccagccgcgcctcgctgcgcctgctgggttcggtgggcgagcccatcaaccccgaggcctggacctggtaccaccgcgtggtgggcgacggccgttgccccatcgtcgacacctggtggcagaccgaaaccggcggcatcctgatcaccccgctgccgggcgccaccgcgctgaagcccggttcggccacccgtccgttcttcggcgtcaagccggtgatggtcgacgccgagggcaagaccctggaaggcgccgtcgagggcaacctctgcctcgccgagcccggctggcccggccagatgcgcaccctgtggggcgatcacgagcgcttcaagcagtcgtacttcgccacctaccagggcatgtacttcaccggtgacggcgcgcgccgcgacgaggacggctattactggatcaccggccgcgtcgacgacgtgatcaacgtgtccggtcaccgcatgggcaccgccgaggtggaatccgccctggtcgcccatcccaaggtggccgaggccgccgtggtcggctatccccacgacatcaagggccagggcatctatgcctatgtcaccctggtcgccggggaagagccctccgaggatctgcgcaaggaactggtcaactgggtccgcaaggaaatcggccccatcgccagccccgacctgatccagtggtcgccgggcctgcccaagacccgttcgggcaagatcatgcgccgcatcctgcgcaagatcgccgagaacgacttcggctcgctgggcgacacctcgaccctggccgatcccggtgtggttgacgacctcatcgacagccgcatgaatcgcggctaatactccacgccaagtgggaagacagaggcccgcggagcaattcgcgggcctcacccttttcaaggccctctttctcaagcaaggatcaccccggtgctgatgatcatggtcaagacggtgctgggcctgggcggggtttacctgctgctggtcggtttcgtcgccctgatgcagcgcggcatgatctaccaccccggcaccacccgcacccgtcccgacgaggcgggactgcccgagatggtgccggttgcgctcaaatccgccgatggctggatcgccaccagttggtatgcgccgcccaagattccgggccgcccgaccatcgtgttctttcacggcaattccggcaccctggccgaccgcgcccataaggcccgcgccttcctcgacgccggcttcggcgtcctgctggcggaataccggggctttgccggcaatgcgggccgccccagcgaacaggggctctacgccgatgccgaggcggccgtccgctggctgaccggccagggcgtgccgtcgcgccgtctggttctttacggcgagtcgctgggctcgggcgtcgccatggaaatggccatgcgccacgacatcatgatgctggtgctggaaagccccttcacctcgctggccgatctggcgccggcctatgtgctgccgccgctggcccagatgctgacgcgggaccgctacgacaacctgctcaaggccgccagcctgcgggtgccgctgctggtggtgcacggcgacaaggaccagctggtgccggtaaccatgggccatgcggtgctaaacgccgccgactccgtcaaggaagggctgttcctgcccgaggccggccacaacaatctgtgggagcatggcgcgggcaagcgggtgatcgacttcatctcgcgccaaatggtctgaaaagctgaagggttcgggaagccatgcttcccgattgggggatcgggggcaaacgcccccgaagtggagccgttccccaacccgcttaacgctctattccagcgcctgccgcagcgccgcggcgctggcccagggggcgaggaccagggcggcggccagcatggccgacaggatcagcagatggggcttggccgacaggccctgcacggcggcatcgatggcccccaccccgaagatcagcaccgggacgtacagcggcaggatcagcagcgacagcagcaccccgccccgccttgcccccagcaccaaggcggcgccgatgccgcccaccagggacagcaccggagtgcccagcgccatggcggccagcagggtcaggaacccgtcctcgtgcatgtgcagcagaacggccagcaccggcgcggccaccatcagcggcaggccggtggtcagccagtgggccagcatcttggccgcgaccaccacgcccaggggcgccggggtcagcaccagcagctccagcgagccatcctcgtaatcggcctggaacagccggtccagcgacagcatggaggccagcaaagcggtgaccatcagcaccccggccgccacgcgctccagcacattggcttccggcccgatgccgaagggaaacagcaccacggtcagcacgaagaaggtcaccaccatgacgctgtccgagccctggcgcagggccagacgcaggtcgcggcgaaccacctcgacaaagcggttcatggaagctcctccgccacggcgaattgatccagatgcagttcctgggcgcccggcatgttgatgtcggcatgggtggacagcaccaccatgccgcccgccgcccggtgctcggccagcacgtcctcgaggaccttgatggaggccttgtccagcgccgtggtcggctcgtccagcagccacagcgggctgggagcagccagcaggcgggccagattggtgcggcgtttttgccccgccgacagcatcttgccgggaatggtggccagccgcgccagcccgaagcgcgacagcgccgcgtccacggcccgcccggcccgctcggcgtggggatcgtgcaggtgcgcccagaaccgcaggttctcggccaccgaaagcaccggcttcaccgcgtcgtgatgccccaggtaatgggtgcgcgccgcatgggcctcggggtcctcggccagggcctcgccgttccaggccagcagcccgtgggcgggcttcaacagcccggccagcacgcgcagcaggctcgacttgcccgagccgttgggccccagcaaaaccagggcgccgcccgccgacagggagaaccccagcccggcgaacaccacgcgcccgccgcgcacgcaggccagattcttggcggagaaggtcgaatcgctcatggcccgcaccatggcaaaaatcgcggcacttgacgaggggtgtttgccctattgcctttttccacggccgaccgatcataggacgtatgaagttggtcggcagaatgctttgggggtacgaggtccggcggcgccatgtggtgatggcggcggccgcgctggtcgtgctcgtcctcggcctggccggcgacctgctgcccgaggcggggttccgctggggtctggccaaggccctgcgcggcctcggcatggtcgaggtcagcatcgacgacaccgatatctcgctgttcggcggccgcctcacggtgcgcaaggtggtggcccagcccgccctgggcaaggccctgggcatcggcgatttcgacctgaaattccgctggcgccccctgctggaccgccgtctggtcgtggaccgggtggcggtcgagggcatcgacatcgacctgaagcgcgacggcgacggcttcgtcctcaacggcctgcccctggcggtggccgccgcgccgccctcggcccaggacccgacgccctcgcccccctggggtatcgacgtggcggggctggaactgacccattcccgcctgcatgtggttgacggcgacttcgtcgccgacatcgccgtcgagcggctgctggtggagaacgtcaacaacctggacccccgccgcgccgtctccttcaccctcaagggcagcctgaacggcgccgccattgccctgtccggcacggcgcaccccttcgccgccgagccctctctcgccgtcgccgcccaggtgcaggccctggccctggccgatttcgccgccctagcggcgcgcgccggcgcggaagggctgagcggcaaggccgacctctccctgacggcggagggcgttctgctcccctctggaccgtcggtcaaggtcaacggccgcctcgccctggacgcccccgccctgactgcgccggccgccgccaaggcgacccgcctggacctggagatcggccgcctgacctgggacggaacccggctcgatctggccgccaccctgggcgccgaggccctggacgccaaggtcgccgaaaccggcggcaccgccgggcggctggacctggaattgggtggcctggcctgggacggcgccaaggcggagcttagcgccgtcaaattcgccaccgaggcgctggccgtcaccgctcccggcggcaagggctcggccggcaagctttccctcgatctcaagactctctcctgggacggcgccaaggccgccctggccggtcgcatcgacggcgccaccctggcgggcaagggcgagggcggcgagggaaccgccgccgcgctggccctcgacgccgcccgcctggactgggacggccgccgggtgggctggcagggcgggctgaaggccaccggcgcccatgtcgccgtggccggccacgatgccgcccccgacgccgtggactggaccggccacttcgacctcgacaccgccgacctggcggggcaggccgagggcaaggtggggctgggaccgctgcgcctggctgtgggcgatatccgcaccggattgcgcgccgccggggccgagggcaaggtgaccttcggcaaggcggtggaggccgaactgcccaagacccgtctggacggcctgaccgttcaggacgcggcccgcaagaccgatctggccacggttgaacgcgtcgaggcccaatccctgaagctggcccgcgacggcgccgtctccgtcgccaccctgaccgccgacggggtgaacgccctgcgcaaggagggccagggtggctataactggcgcctggaaaccaagcggctgcgccttgaccgcgccgcccgcgatggcgatggcgacgtctccgccgacgaggtgcgcattgacggcatgctggcccgcgtcaaccgcacccccgagggtctggtcggcttcatctccgacgacaaggcgcccaaggacgccaaggagaccaaggcggcccggaccagggacgaggacaccaccgacatccgcatcggcaagctgatggtcggcgacagccgggtcaacctgcgcgaccgcaccatgacggaaaccgtgcgcatcgacgtgatgccgctggacttcatcatcaccaatctggacagcgaagcccccgaccgggattccgcctttgagatcaaggcaggggctggccggggcctgatcaccgcggcgggcaccgtgcggcccttcgccgacaagatctccggccgggtcgatggcaagatcaccgccttcgaactgccgcccctgtcgccctatctggccgaggccctgggggtcaacctgcaatcggggcatttcgacggcaccctgggcgtcagcgccgatcagggcaaattgtcgggcgcgctgaacctggccctgtcccagctgttcatcgcgccgcccgatcccaaggcgccggccaagccgggcaagatcgacatgcccatcgccacggttctcgacctgctgcgcgacggcgacgacctgatccggctgtccctgcccatccggggcgacaccaccaatcccgacgtggacatcagcgacgccgtggcccaggcggtggccggggcgctgaaatccaccctgctgaccaccctgaagctggccttcccggtggcggcgctgatcgaactggccatggatgccgacgatccgtcccatctggccctgccgcccctggccttcgcccccggaatcgacgccctgacgcccgagcacgagaagaccctgaccgcggtcgccgaactggtgaagggccgcgccggcctcaagcttaccctgtgcggcaaggccgacgacagcgactggcctgtggtggccgccaaacgccgcagcgccgaccggccgctgctgtccaagctggaaaagctggtcggctatgatcgcccggccgaatccttcggcccgcccgaccacaacctgctctccgccctggcccagcgccgtaccaacgccgtgcgcgacttcctggccgacaagggcggcgtcgagcccagccgcctgttcggctgccgccccatggtcgaggcggccgagaaggggccgagggtggagttgctgctgtagggcggccctgttcaaacccatctgcttgtgggctctgcccacacccgcaaagggcctcgggccctttgatcccaagggttaagtccgcgcccgaggagctcggaccttcgtgaggcgaccgcccttgcggacatcggccggctggacctgatttgagcgaacgcccaagtgcgactctggccccggccttcccgccgaatgggtgtggccattttcatatggggaagcaaccaattggaattccgcctcaacgcttagatctacggtaaaggtcagagaaacattcaggaaaatcacgatgtgaattagtgtatttttcatactgcttttactccataggcattgttctcatgtcgaatccgatcatgaggtgttaaggcgctgtatttaggagtcgagggaccgccggattgccttgaacgcagcaatacacctcgcgataccaaaccctaggtcggcagtcgcgtgggtatagtgagcaagcaagtcaagaaggccaggtccgacaaccagcgcccacatgaagagttccatgcgggaatctcctgcgggtcaccaagtgccccagcagaggtctgaaccatgaattggatgggggaacccatctcagttcacatcgaacataaaaaatccgccagagattaccccttggcggctagatatgcgattgtgcagaaagtacgggatttaaccgcactcgtcaagtacttcttgattcagcgcgcccatcatggtccatctatactacagatcgacctgacctgacatcatattattgctccccttccagacaaaccaaggggatcaaagggcccaaggccctttgcgggcgtgggcagagcccacaaggatctccccctccccttcgacggaaagtggccgagccacaaacaagaagggcgacccgagggtcgcccttttcgtttagtcgttcttggcggcgcgatcggccttcttgcgctcgttggggtcgagcaggcgcttgcgcaggcggatggacttgggcgtcacttccaccagttcatcgtcctcgatataggcgatggcctgttccaggctcatcttgcggggcggggtcagcttgacggcctcgtccttgccggcggcgcggatgttggtgagctgcttggccttcagcgcgttgacttcgaggtcattggggcgattgtgctcgccgatgatcatgccctcgtagatcttcacgttgccggtgatgaacatggagccgcgatcttcaaggttccacagcgcgtaggtcaccgcgtcgccctggccgttggagatcagcacgccgttgcggcggccctcgatggcgcccttgtagggggcatagccgtggaacatgcggttcatcaggccggtgccgcgggtgtcggtgaggaactcgccgtgatagccgatcaggccgcgggcgggcgccaggaaggtgacgcgggtcttgccgccgcccgacgggcgcatgccggtgagttcggccttgcgcaggctcatcttctcgaccacgacgccggaatattcgtcgtccacgtcgatgaacacttcctcgatgggctccaggcgcttgccggcatcatcggtcttgaacagcacgcgggggcgcgagatggacagctcgaagccctcgcggcgcatctgctcgatcagcacgcccagctgcagctcgccacggcccgacacctcgaaggcgtccttgccggcggtctcgcggatatggatggcgacgttggactcggcttcacgggccagacgggcggcgatcatgcgcgaggtgaccttgtcgccttcctgaccggccagcgggctgtcgttgaccgagaaggtcatggacagggtcggcgggtcgatgggattggccttgaggggctcggtgacctcgggggcgcagatggtgtcggccacggtgggcttggtcatgccggcgatggcgatgatgtcgcccgcctcggcgctttccaccggaatgcgctcgatgccgcggaaggccagcagcttggagagacggaactgtcgagcagctggccgtcgtgggacaggcccttgacctgcatgttcagcttggccgtgccggaatagatgcgcccggtcagcacgcggccgagataggggtcggcttccagcgtggtggccagcatggagaacggcgcctccaggtcgcgccggggcggcggcacatgagcgacgatcaggtcgaacagggccgagaggtccttgcgcgggccatccaggctgtcgtcggcccagccgtcgcggcccaccgcgaacatggtggggaagtccagctggttgtcgtcggcgtccagcgccgcgaacaggtcgaagcactcgtcgtgcacttcgtgggggcgcgcgtcgccgcgatccaccttgttgatcacgacgatggggcgcaagcccaggcccagggccttgccggtgacgaacttggtctggggcatggggccctcggccgcgtccaccagcaccacgacgccgtccaccatggacaggatacgctcgacctcgccaccgaagtcggcgtggccgggggtgtcgacgatgttgatgcgcgttcccttccactcgaccgaggtgcacttggccaggatggtgatgccgcgttccttttccaggtcgttggaatccatcacgcgttcagcaacctgctggttttcgcggaaggttcccgattgccgcagcatggcatccaccagagtggtcttgccgtggtcgacgtgggcgataatggcgatgttgcgaagttccatgggactcgtcttaccggagattttcgaagatatggggacccagcttggcgcgggccagatccttgagcgaacgctcgggccgggcgccgtaatgggagatgatttcaccggcggcaatgccgccgagaatggcgcaggaggcgagatcgcgcccctgggtgaagccgaacaggaatccggccgcatagagatcgccggcaccggtggtatccaccagcgcctcgatatcgtcggcggcgaccacctggacctcgtcctcggtcaccaccaccgaacccttgtcgccgcgggtcacggcggcgacgcggcaatggccgcgcacggcgcgcaccgcctcgtcgaaggactcggtcttgtacagcgagcacaactcggcctcgttggcgaacaggatgtccacatggccggagaccagatcgaggaaggcatcgcgatggcggtcgacgcagaaggggtcggacagcgacagcgacaccagccggccggcgccatgggccgtggtggcggccttgaggaaggcacgcttggcctcgggcggatcgtagagatagccttcgagataggtgacctcggcgccggcgatcaggccggcatccacgtcgtcggggccaagttcgacgcaggcgccgagataggtcagcatggtgcgctgggcatcgggggtgaccaggacgaagcagcgcgccgtcgaggcgccgtcactggccgccatggtctcgaaatgcacaccggaattgcggatgtcgtggcggaacacctgacccagctggtcgtccttgaccttgcccacataggcggcgcgaccgcccaaggcggcgatgccggcgatggtgttggcggcggacccgcccgagcattcgatgcccggcggcaactgggaatagatggcctcggcctgctcggcgtcgatcagggtcatcacgcccttggtcaggccgagacgatgcagcagcagatcatcggcatgcaccagtacatcaacgatcgcgttgccgattccggcgacgtgaatggtcttgtccgccatggctagatacgggccttctcgcaaggaaagtctgcgccccgggcgctgacgcgccatttcctgaggcattttgcggcgcagtatagccaggaagccgccataaacaacaaaaaccgcctttggccttggcgaatggcgcggagcgtgcttgaatccgtggtttccccgcccccgttccatggacctccatgaccatccccgccgccctgtacaaggccttcgcccaactgagcgatccccgcctgcgccgcatcctgctgttcggcgtggcggcggccctggcctgctgggcggcgctggccatgggcgcctcggcggtgttgcgccaggttcacctgttcgacaacgccctggcccagaccagcgccgagatcgtcctggtgctgaccgccctgctgctgcccatcctgtttttttcggccctggccaccttcgtcatgagcttctggctggacgacgtggccggcatcgtcgaggccgagcactatccccatctggccccggcgcgggagatgggctgggccgaaatcctgaaggggtcgctccgcttcctgctggtgatggtgctgatcaccgccctggcggcgccgttctatctggcgctgctgttcctgggcttcggcatcatcctcaattacggggtcaacggctatctgctgggccgcgagtatttcgagctggtggcggcgcgccggctggagcccgaggccatgcgcctgaccttcggcaacaatctcggccgcctgtggctgtgcggcgcagctatcaacctgctgttccagattcccatcctgaacctcaccgccccggtggtggccacgtcgttcatggtccacatcttccactcgctgaggacggaatgatcaagcgccttgcgtcagcctcgctcctgcttttgctggccgcctgcaacggggcgggcaattcggccgccaccggcggaccagccaccggcaggccgagccggggcggcgacgaggacgtcgccatgatggcgccgccggcccccggcagcatggcgccctcggccctgcagggcatgagcgccgccgccgtcgaacacgccctgggcaagcccgccttcgtgcgccgcgatcccccggccgaaatctggcaataccgggtcaagctctgcacgctggatctgttcctttacgaggacaacggccgcaccgccgtggcccactacgccgtgcgcacccccggcggcaattcggtcagcgaccggggctgcctggacgaggtcctggcccggcgcgacggcacgccgaccagctgagggccggttttataccaacccgctggcgcgacagggccaccgccctgacccgttcggaggcgcagccttcgaaccaccagtttttcaagaaactgaagggatcgggggcaaaagcccccgacggggagtggcgccgatgggctacacccccttcagaccctgggcgatgcggcggatatgggcacggatttcgctctcggccgcttcgccgtcgcggtgcaccaccgcctcgaccatgcgcgcgtgctcctccacccgctcgtccatcaaggcgggacgcaggtccgggcggatgcacatggccttggtccgcgcccacaggcgttcgatgatctccaccatcacgacattgcccgaggcctcggccagcaggcggtgaaagcgctccacctcggtcgcataggcctcgtgggcgctgtccgccacggccgagcgctgcaggccgatggactcgcgcagggccttgatctgctcgggactcgccttctcggcggccagacgggcggcggcgccttccagcgcctcgcgggtggcgaggatgtccatcaggcggcccttgtcgaagccgacgaagaacacgccgtgacgcggccagacctcgacgatgccgtcggcttccagccgggcgatggcgttccacaccggcgaacggctgactcccagctggcgcgccagatcctcgacgctgatcttgtcgccgggcatgaagcgcccgccgcccagcagcatctcgtgcagcaccttataggcctgatcggccagattggtcttttgcagcttcaccttggccctcccctcttgctgggatgatgcaccaactggactcttggggcaaatgcgaataatgtatcacgtaacatgaaacatgaggtggcgtgatgagctttcccctggtgcggctgccgctgccccgcctgctggcctggaccgccgtggcggtgggcgcggccattgtcgttctcgaccctttgccgggcaccgaagggcgcgtcctcggactggcggtggccttcatcgggctgtgggccacggcggtgatccccgagcccatcaccgcggtgttcttcttcacggccgccatgctgctgaaggcggccccggcctcggtggtgttcggcggctttcagtcggcggcgctgtggctgatcttcggcggattggtcatgggcatcgcggtgcgctccaccggcctgggagagcggctgggcgcccggctgagccacgccttcggctccagctattgggggatcatcaccggggtcaccctggtgggcctcgccatgggcttcctgatgccgtcctccatggggcgcgccatcatgctgatgcccatcgccgtggggctggccgagcgttacggcttcgagcccggctccaacggccggctgggggtggtgctggccgccgccttcggctgccatgtccccaccttttccatcctgcccgccaatctgcccaatctggtgctggtgggcgcctccgagaccctgtggcactacacgcccaattatggcgaatatctgctgctgcacttcccggtgctgggctttctcaagaccgccatcatgattccgctgatcgtcaagctgtggcccgacacgccgcggcccgaggcggcgggacgggccatgggccccatgaagcgccaggaggggcagctcgccctgctgctggccgccgccctggtgctgtgggccaccgacttcgtccaccatgtcagcccggcctggatcagcatggcggccggcgccctgctgctgctgcccggcgtcgggctggtggaccgcaaggccttcaacgagcagatcaattacggctccatgttctatgtggccggaatcatgggtctgggcgccgtggtggcccaatcggggctgggagcgcggctggccggagccatcctcgaggtgctgccgctggccccgggccatcaggccaccaacttcgccgccctggccgtgctgtccacggtggtcagcgtgctcaccaccctgcccggcgcgccggcggtgctgtcccccatggccggtcagatggccgaagcctcgggactgtcggtggaggcggtgctgatgagtcaggtgctggggttctccaaccccatcctgccctacgaatccgcccccatggtggtggccatgcaattgggcggcgaacgcctgggcccggcccagacgctgtgcctgtggctggcgggaatcaccattgtcgtcctgctgccgctgaacttcctgtggtggcgcctgctgggctggatctgacaaagatcccgcttcgcggcagggcacccgcccggacccgttcggaggcacagcctccgaaccacccgcttttttcaatgaattgaaaagctgaagggttcgggaagctatgcttcccggttgggggatcgggggcaaaagcccccgaaggggcattctccgcagccgattagaacagagcgtactggttgaccggctggcccgccttgggccgccgggcggcgacggcggctggcggcggaacggcggggcggcggggagccggttcggcccgcaccaccggggccggttgcacgaccggcgagacggcctgaggcatcgccaccggcggcaggggatgattgcggtcggccagacgctcgtccagttcgcccttgagggcggtggccaccagacccaggcggcggttctcggcctccagccggtcggtgcggcccttcagcgcctcgagctgggcggccagacgctcggccgcctcgatggcctgggccagatcggccagacgggcctgctcggccgcctgggcggcgtcggcgcggcgggtctcggcgcccagggtttcgcgcaactcgtcgcgttcggcctgcagacggatgacctgggccacatcctgggcggcggtggccagaccgttcgccggggccggagcggtctggcgcagcttttcgttttccgagcgcaggtgacggatttcgttgcgcaggtcgaagaccgtgtcttccaggtcctccagccgggtggagctgaccaccggcccgccttcggcgacccgcgacgccagggcgacgaagtccagcccggcgccttccagcagccgcccggcggtgcgcaaggcgtgcagcgcctcggcatcgttgtccgaagcggccagcgccagcaccttggcaagtcgttgaacgtccatgagcccctattccccgagaacgccggattctgtcaaaagccgagtccgggggcaaaccatattttgtggttcggtccgagaccgccccaccacggccagatccgtcgtggagtcggtgacttagtcacaagacattctggagaggttttcatatactgccggcctaatataaattcccggagagcccagcatggacaccaagcccgccgtaccggccttgccgctgcacaaaggcgaggtgccggtctacatggagaccggcaaggcccagccccgcgcggtcagcggcaccttccgctcgtggaagtggtggtccatgatcgtcaccctggcctggtggcatctggggccgttcctgcgctgggaccgggggccgggggcgcccaatcaggccatcctgatcgatatgccgggccgccgggcctatatgctgttcatcgagatctggccgcaggagatctactacctgaccggcatcctgctgatctcggccatcctgctgttcctgatgagcgcggtggcgggccgcgtctggtgcggcttcatctgctggcagacggtctacaccgacctgttcgtggcggtggagcggctggtgatcggcgaccgcagccagcggatcgccttcgagcgccagcccctctcggcgggcaagctggcccgcaaggcggtgatcaacctgctgtggctggccatctcggcggcctgcggcatcggctttaccttgtggttcggcgatgccttcgagatgctgcgtgacatcttcaccggccaggccaacccgccggtctatgccttcgtcgccatcctgggcgggttctgcttcctgctggccggctatgcccgcgagagggtctgcgtctatctctgcccctattcgcgctttcagtcggccatgttcgacgagcattcgctgatcgtcacctacgaggcgtggcggggcgagccgggcggcccggcgcgcaagggccagagcttcgaggggcgcggccattgcgtcgattgccgctcgtgcgtccaggcctgtcccaccggcatcgacatccgccagggcaatcagctggcctgcatcggctgcgccctgtgcatcgacgcctgcaatcaggtgatggaccgctacggcctgccgcgcggcctgatctcctatgattccagctccaacatcgaagcgcgcaaatgcggcaagcccaccggtttgcgcatcatccgcccgcgcaccatgatctatggcggcatcatggccctggccgcctcggtcatgctgttccgcctgaccacccggcccgatgtggacgtcaacgtcctgcacgagcgcgccccgctgttcgtccagatgtccaacggctccatccgcaacggctatgtctacaaggtgctgaacatgaaggccgaggaccgggtcttcagcgtgcatctggaaggcgtcgaggatgccgccatcgacgtggtcggcggcgccagcaatgtggccaaggccgaactgcgcgtgccccgcgattccgtcggcgagttccggctttacgtcaccgttcccgccgccaaggcggcgtccaagagcatgccggtcaccttcgtcctcgacggctccagccgcgaggtgcgcaccaggaccatcttcgccgggccggaaaagtaagctttccgtttaccccctattcgtcgtcgcccaagtcgacccagctggggtcatggccgacgcggtgggcgggcgaaaccagactgggcttggcggccggctcgcccagggcgggcagcaccgcctcgcccagggcgtcgcgaatggcggcggtcaattgctcgggcgagaccggcttgccctggaaccgcaccgccggccccacctgctggtgcgagacggcgggcgtccaatgacccgacaggaccagcaccaccacgtcgggataggcctcgtacatctcggcgatcagcgccttgccgtccatgaccggcatggcgatgtcggtgaccaccacatggacgggctcggcggccatgatgtccagggcctgaagagcgctggtggcgaacaggctgacccactcgtcgccatactccagcatggtccgccggataccttcgagcaccctgggctcgtcgtcgacgaatagaacacggccgtgccccatggctcactccctgttgttcacaaaggggccggtcggccccggctttccggtcagaacacgtccttgcgccgccgcaattcggcgaagaccaaagcgggatcggttcccggctccagccccaccgcccgggcgatcgcggcggtgtcggcccgcaggaagggattggcggcacgctcgtcggccagccgcaccggcacggtgggacggttgtgggcgcgcaggcgctccacctcgtccagccgggccttcagcgccccgttgtcgcgctccaccagccgggcgaagcggccgttgccggcggtatattcgtgggcgggataggccagcgtgtccggcggcaggtcgcgcagcttcttcagcgaggcccacatctcctcggccgtgccctcgaacagccgaccgcagcccagcgagaacagcgtgtcgccgcaaaacagcacatggctgtcggccagccagtaggccacatgccccgaggtatggcctggaacctcgaggacggtgacggcggcatggcccagcatgaaggtctcgccctcggacacctccagggtgatgccggggatgcgctcggaatcgcgggccgctccgaccacggcgcagcccgtgcgccgcgccagatccagattggccccggtgtggtcgccgtgatgatgggtgttgaggatatgggtcagcgtccagccccgggcggccagacgttccagcaccggctcggacaccgccggatcgatggcggccgtggccccgcccaggggctcgtgcgccagatagacgtaattgtcggacaataccggaatctgctcgacgatgatcttggccatggacatccacccgcagcgataggccgaatgtagcatcaagcggccgaaacgcctatccttgcgccatgaatcgagacctgtcctatcccgccatgtggaccgatgtggtcgatctgcgcgatttttacggcagcagcctgggccagaccgcccagcggctgatccgccggcaggtgcgcgccctgtggcccgacgtcaccggccagcgggtcctgggcctaggcttcgccacgccttatctgcgcatcttcctcgccgaggccgagcgggtgatcgccgccatgccggccagccagggcgtgctgccctggccgccggaaggtcccggcctcaccactctggtggacgagaccgacctgccgctgcccgaccgctccatcgaccgcctgctgctggtccatgccctggaatccgccgaacaggtgcgcgccatgatgcgcgaggcctggcgggtgttggccgatggcggccgcctgatggtggtggcgcccaaccgccggggcatctgggcccggctggagcgcacccccttcggcaacgggcggccctacaccatgggccagttgaaccgcctgctgcgcgacaacatgttcacgcccatcaacaaggcctcggccctgttcctgccgcccaccacgtcgcggatgatgctgcgctcggcctcggcggtggaaaagatcggccagcgctggttcgagaccttcggcggcgtgatcatggtcgaagccgccaagcagatctacgccggctccgccgtgcgcgaggccaagggcaagcgccgctcctacctgccggtggcggaagggttctcgcgggtgatgaaataggcacctaatagcggccattgaggccgcggccaagcgggcggaagcccgcgcccggcgagggactgacatgatctagcgggacaggatgtcccgcagccggtcggcttggcgggaatccacgctgcggctgaacaggatgtcctcgggcgtcggattgccgccgtaataggcggcgttccacgaatgacggggcaggatgccggcgccgtccagggtggcgccgccgtaaagccccacggcgcgggagaaggcatagatatccgcccccacattggtggtggtgttggccgaggcgccggcgccgaccaccgccaccgccacgccggcctcggcgccggccttgaactggttctccaccacggccttgaggccaccctcgctcatgatgacatagaccgcctcggcatcctgcaggccgatctgcagcccgacgctgcccgccgcgatggagtagaaggccggaccgctccagcgtcccgacccgtcgcgggccagcagcacgccggtgccgtattgcgcccccaggatgaacccgcccttgaccagatcgggcaccaccagcaccgcccgcgcccgccccagcagattggccatctgcccactgaaattgggatcggcccgcaggcgctccaccacggtgaccgccttgcccaccatcatggtctgatcggtgacctgctgggccttggcgccgccggcgagaaacagaaccgcaagggccagggcgatcagtctggacatggaggcctccgtggaaaactgtggtcgctccactccaaccacgagcgtggttaggattttgttaacccttgcctgccatgccctttgagggtaagcctgtaacgcttccaaacggaaggacgctgagcggatgttctccctgatcatcaacggtgaacggcacaaggtggacgccgcgcccgacacccccttgctgtgggtgctgcgcgacctgctgtccatgacctccatccgctacggctgcggccagggcctgtgcggtgcctgctccatcctggtggacggcgagccgacccgggcctgccagacccccgtctccgagatcaacggccgccgcatccagaccctggccggtctgggcgacgccgtctcggcccagttgcgcgccgcctggatcgagctggacgtgccccaatgcggctattgccagtcgggacagctgatcagcgccggcgccctgctgcgccgcaatcccaatcccagcgatggcgacatcgacaccgccatgagcggcaatctctgccgctgcggcacctatcagcggattcgcgccgccatccatctcgccgcccggcggctgcggggggcgtcatgaagcgcgccgtccccacgggcggaatcgaccgccgcaccttcctgatcaccaccgccggagccggactggccctggcggtgggcgacgcccacgccgataccgaggccgagggctggcggcccaatgccttcgtcgccatcgggccggatggcaaggtgacggtgacggtcaagcatctggagatgggccagggcgtcgccaccggcctgccggtgctggtggccgaggagttagaggtggaccccgcccaggtcagcgtcgccttcgcccccgccgacgccaagcgctacaataatctgttctggggaccgagccagggcaccggcggctccaccgccaccgccaattcctgggagcagctgcgcctggccggcgcggcagcacgcgagatgctggtggaagcggccgcccgaatcctgcgggccgacgccgccagcctgagcgccgtcaatggcggcgtcgtccatagccccagcggccgccgcctgggctatggcgaactggtgtcggtggccgccaagctgactccgcccagcgccccggccctcaagcccgcctcccagttccgcctgatcggccgcgacggcgtcaaacgcagcgattcccgcgtgaaaagcgacggcaccgcccagttcggcgccgacctccgcctgcccggcatgctgaccgccctggtggcccgcccgccggtctggggcgcccgcccggacggccatgaccgcaaggcggccctggcggttccgggggtgatggcggtcttccccatcccgtcgggcatcgccgtggccgccagctcgttctgggcggcgcacaagggccgcgaggccctgaacgcccgctgggccgaaccggcggacaaggtctccaccgagagcctgcggcgcgactggaccgccctgctgggcaaagccggccgcccggccgccgcccgcggcgacgccgaggccatcctggcccaggcggcgcagcgccagagcgccacctacgaactgccctatctcgcccatgcccccatggagccgctcaattgcgtggtgcgcctggcgccgggcaaatgcgagatctggaccggctgccagttccagacccacgaccaggccatggccgccaaggcggcgggtctgaagcccgagcaggtggaaatccacaccatgctggccggcggcagcttcgggcgccgcgccaaccccacctcggactacatcgtcgagggcgtcgaggtggccaaggtgctcaacaccccggtccgcctgatgtggacgcgggaagacgacatcgccggcgcctattaccgccccatggccctgcacggcttcgaggcggcgctggacgagcgcggcatgccgctggcctggcgccaccgcgtcgtctgccagtccattctggacggcggccccttcgccggcatgatcaaggacggcatcgacccggtctcggtggagggcgcctccaacctgccctacgccatccccaatctggccgtggacctgcactcgcccaaggccccggtgccggtgctgtggtggcgctcggtgggctccagccacaccgccttcgccaccgagtgcttcctggacgagttggcccaggccgggggcaaggacccgctggagctgcgccgcgccctgctggccgaccagccccgccatctggccgtgctggagctggccgccgccaaggccggctggggctcgccgctgcccgccggcaagggccggggcatcgccgtgcatgaaagcttccactccttcgtcgcccaggtggtcgaggtgagcatcggagccaagggcgagatcaaggtggaccgcgtggtctgcgccgtggattgcggcgtggccgtcacccccgacgtggtccgcgcccagatggaaggcggcattgccttcgccctgtccgccgccctgttcggcgagatcaccctgaaggacggccgggccgagcaatccaacttccacgactaccgctgcctgcgcatgaacgagatgcccagggtggaggtccatatcgtgccctcggccgcgccccccaccggcgtgggcgagcccggcgtgccgcccctggccccggccctggccaacgccatcttcgccgcaaccggcaaacggctgcgcaagctgcccctgggcgagcaggtgtaggtgcaggtgtcatcccgagagagcatcgcgaccgagggatctcgtcctggcacaccacatcagaacgggcgccggcgatccaggtggagatccctcgcttcgctcgggatgacaatcgaggtcgacatgaacttttgttcaccgtccgcccgttcgactccgctggaaaagcggcgggaacggcggtaagaagaggccccatgcatcgcttcgccaatcccgcccgcttcctgcgtctcgccaaggtgatcctcccctggtcgaacgccgtcgccatcctttgcctgggagctggtctttacttctccctgttcgcctcgcccgccgactaccagcagggcgaaagcgtgcgcattatgtatgtgcacgtgccgtcggcctggatgggcatgttctgctatgtggccatggcggtgttctcggccatggcgctgatctggaagcatcccctggccgacctgctggccaaggccaccgcgccggtgggtgccgccttcaccttcctgtgcctgctgaccggctcgctgtggggtaagcccatgtggggcacttggtgggcctgggatgcgcggctgaccagcatgctgatcctgctgttcctctatctcggctacatggccctggtgaacgccttcgacgaccccgagcgcggccacaaggccgccgccatcctggccctggtcggtgccgtcaacgtgccggtgatcaagtggtcggtggactggtggaacacgctgcaccagccggccagcgtggtgaagatgggcggtccggccatcgacggctccatgctggtgccgctgctgctgatggcggtgggcttcaaggcctattggatctccatcctgattctccgaggccgcgccgagatcgcgtcccagaaaatccgcgtcatccgcatggcgcagattcacgccgcgtcgcaaggggagtgaccaacgtcatggaatccttccaggctatgctgcatatgggcggctatggcggctatgtgtggcccgcctacggtgtcggcatcgttctgcttgttctggtgctggcgctgtcgctctcctcggcgcacagggccgaggccgagctcgaggtgctgcagcaggcccggcgcgcccgccggggcaaggattcggagagcccagagtgacccgcaagcaacgcaggctgtatttcgtccttctcggcatggcggcgctcggtggcgccgtggctttggtgctgaccgccatctccgacagccttgtctatttctattcccccaccgatatcgtcagccagcgcatcccggaaggccggcgcatgcgcatcggcgggctggtggaaaacgattccgtggtcaaggacggcaagaccgtgaccttcaaggtcaccgacgtgaccaatgccgtgccggtggtctataccggcgtgctgcccgacctgttccgcgagggccagggcgtggtggtggagggccgcatggaggcaggggggcacttcaaggcctcggaggtgctggccaagcacgacgagaactacatgcccaaggaagtggccgaggccctgaaaaagtccggccagtggaacgacggcaagcagccgaagcaatgatcgaggatggtgtcatcccgagcgaagccgagggatctcatcctggtacttcggagcagaaggagatccttcgcttcgctcaggatgacagcctgaggtgtcgcatcgcaggaacgcaagcctagtgaggttatccccatgatcgccgaaatcggccatttcgccctggtgctggctttgtgcgtcgccctggtgcaggcggtggtgccgctggtgggggcaaagcgcggcaacctggcctggatgaacgtggccggccctgccgccaccttgcagttcctgttcatcgccatggccttcggggcgctgaccaacgcctatgtcaccagcgatttctcggtgatgaacgtcgcccagaacagccataccgacaagcccatgctctataaggtggccggggtgtggggcaatcacgagggctcgctgctcttgtggatcaccattctgtcgctgttcggcttcgcggtgaccctgttcggccgcaacctgccgccgggcctcaaatcccgtgccctggcggtgcaggccatgatcgccgtcggcttcctggccttcatcttgctgacgtccaaccccttcgcccggctggacccggccccggtcaacggccagggcctcaatcccatgctgcaggacccgggcctcgccttccatccgccgttcctctatctgggctatgtgggcttctccatggccttctccttcgccatcgccgccttgctggaaggccgcgtcgacgccgcctgggcgcgctgggtgcggccgtggacgctggccgcctgggtgttcctcacctgcggcatcgtgctgggctcgtggtgggcgtattacaccctgggctggggcggctggtggtattgggaccccgtggagaacgcctcgttcatgccctggctggccggcacggcgctgctccactccgccatcgtggtggagaagcgcgacgcgctgaaaagctggaccatcctgctggccatcgtcgccttcggcctgtcgctgctgggcaccttcctggtacgctcgggcgtgctgaccagcgtgcacgccttcgccaccgacccggccaggggcgtgttcatcctgctgctgctgtgcggcgcggtgggcggatcgctggcgctgtacgcggcgcgggcgccgtccatgaagatgggcgggctgttctctcccatctcgcgggaaggcgcgcttctcctcaacaacgtgctgatggccaccggcgccgccaccgtgctgctgggcaccctttacccgctgatcgccgatgcgctgaacctgggcaaggtctcggtggggccgcccttcttcaacgcggtgttcctgcccctgatggcccccatggtgctggtgatggccgccgctcccatgatgtcgtggaagcgcggcgatctggccggcgtgctgggccgcctgaagttcatcggcgccctggccctgggcgccgccatgctggtgtggttcctccaaggcggctcggccggtccgtggtggaccgccgccggcttcgccctggccgtgtggctgggcctgggcaccctgtgggatctggccgagcgcatcggcctgttctcgcgccccggccaggcgctggcgcgggcggccaagctgcccaattccgcctggggcatggtgctggcccatttcggcctggcggtgttcatcgtcggcctgaccgcctcgtcggcctggaccaccgagcgcatccagacccagaagctgggcgagaccgtgaccgtggccggctatggcatcacgctgaaggcggtggacgaggtccccggccccaactacaccgccacccgggccaccttcgagatctccaagggcggccaagccatcgcggtgatgcagccggaaaagcgcctctatcgccagccgccgcgccccaccaccacggcggccatccgctcgggcttcaccggcgacctctacgtggtgatcggcgatcccgatcccaacaagggcggctgggtgacgcggctgtatttcaatccctgcattccctggctgtgggccggcgggctgctgctggtgatcggcgggaccatctccctggccgaccgccgccaccgggtgggcgcgccgacccgggcggccagcgccgccgccaaggcctgaggagagaccgcccatgcgccgccttctctacatcctgccggtggcggtgttcgccatcctggccctgttcttcctcaagggcctgacgctcaatccccgtgacattccctcggtgctgatcaaccggccggtgccggagatggccctggccccgctgccgggacggggcgagacttcgggcctgaccacccagtcgctgaagggccgggtgtccctggtcaacatctacggctcgtggtgcatttcctgcgtccaggagcacccggtgctgatggagatcaagaagcggggcgacgtgcccatccacgccgtggactggcgcgacgatccggtgctgggcgccgcctggctgaagaagaacggcgacccctacgagcgcgtcggaatcgacccgccgccgggccgcaccgccgtggatttcggcgtcaccggcgcgccggaaagcttcatcgtcgatagggacggcatcatccgctacaagcatgtcggccccatctccaaggagatctgggccaagacgctgctgcccatcatccgggagctggagaagaaatgacttccatccgtcatcccgaacaccgtgagggatctccgcctggatcatcgcgtccggcccggcacgaatggagcagaatgggatccctcggcttcgctcgggatgacaggcggatcggcgcggcccttgtcgccctcctgctgctgtccacgcccgccctggcggtcaatcccgacgagatgctgaaggacccggcccaggaacaccgcgcccgcgaattgggcaaggatttgcgctgtctggtctgccagaaccagtccatcgacgattccgacgccgatctggccaaggatctgcgggtcatcgtgcgcgagcgcatcgccaagggcgattccgacgatcaggtgagagccttcgtggtcgaccgctacggcgactacgtgcttttgaagccgccgttcaaggccacgaccctggccctgtggctgggaccgctggggctgttcctgggcgcggtctgggcggtgctggccttttaccgccgccgcccgggcgagaagaccacgccgccgcccccgccgctgtcggccgaggagcagcgcaagctggacaagctgttgaaggagagcgagcggtgatctggatcgttttcgccgccatggtcgccctggcgctgctggtgctgctgcgcccgctgctggccgcccccgccgccatggccgcccgctcggattacgacctgatggtctataaggaccagttgggcgagctgtcccgcgacgtggagcgcggcctggtcaacgccgatcaggccgaggcggcgcgcaccgagattcagcgccgcatgctggccgccaccgatggcgacaagggtggtggcgccgccgccgcgctgcgcaagggcaaggtggcgccggtcatcatcaccgtgctggtgccggtgctggccgtgctgctttatctgcccctgggcgcgccggaactgcccgacagcccctatgccggccgcgtcgcccagatcaacgagatgaaggaaaaggccgccaccatccaggccatggtcacccgtctggccgagcgtctgcggcaggacccatcggacggcaagggctgggccatgctgggccgctcgtaccgggccatgggcatggccgaggaggccaaggacgcctaccgcaaggccgtcaccctgctgccgtccgagacccaggcgcgcatcgagctggccatcatgctgctggaagaggccgagggcgacgccctgcccgacgaggccgtcctgcgcctggaagaggtgctggccatcaccccggatcagccggacgccctgtatttcaccggcctgtcggcggccatgaagggcgacagcgcccgcgccaaggcccgctggaaccgcctgctgatggtcctgcccgccgattctccggcgcggggccaggtggagaaggacatggcccggctgaagtgaggggctccggcaggaatgacggcttgagccccttgcccccggacgccttcggctgtatgagtttcccccatgcatatccttgaattcgaaaagcccatcgccgagctcgagggcaagattgaggagctgaggcacctgtccgatggcggcgacgtcaacatcgccgacgaggtgtccaagctccaggccaaggtcgacaagctgctgcgctcgacctacgccaagctcacgccgtggcaaaagacgcaggtggcccgccacccggagcgtccgcacacgctggcctatatctcgacgctgatcgaggacttcacgccgctggccggagaccgcgccttcgccgaggacgaggccatcatcggcggcctgggccgcttccgcggccgctcggtgatgatcatcggccacgagaagggccacgacaccgaaacccggctgaagcacaatttcggcatggccaagcccgagggctatcgcaaggccaagcgcctgatggaaatggccgaccatttccaggtgcccatcatcaccctggtggacactgccggcgcctatcccggcgtcgacgccgaggcgcggggccaggcggaggccatcgcccgctccatcgagacctgcctgaacgttcgcgtgccgctggtctcggtgatcatcggcgaaggcggctcgggcggcgccatcgccctggccaccggcaataccgtcctgatgctcgaacacgccatctattcggtgatcagccccgagggctgcgcctcgatcctgtggcgctcggccgagaacgccaaggacgccgccgaacagctgcgccttaccgcccaggacctgcacaagctcagcatcatcgattcggtggtgcccgagcccatgggcggcgcccatcgcaatcccgacctgatgatgcaaaccctgtccatggcgctggattcggcgctgcgcgacctgtcgggcctggacggcggcgtgctgcgcgcccgccgtcgcgagaaattcctggagatggggcgggcgggcctgtcgtgaccagcctcgtggttccggaactgtcggtagtcgtcccggtcaagaacgaggccgagaacatcctgccgctgctggacgagatccacatggcgctgcagggcaaggtggagttcgaggtcgtctatgtggatgacggctcggacgatgccacgcccgcggtgctggagcaggcccgggccatccatccccgcctgaaggtggtgcgccaccgcaccggctgcggccagagccaggcggtggccaccggggtgaagcatgccggcggcaagctgatcgccaccctggacggcgacggccagaacgaccccgccgacctgcccgccatgctcgagcactggcgctcgcgccccgagaccgtgcgggccgggctgatgatcaccggctggcgcgccaaccgccgcgacgacggcatccgccgcctgtcgtccaagctggccaatgccatccgctccaagctgcttcgggaccagaccccggattcgggcagcggcatcaagctgctgccgcgcgaactgttcctggacctgccccgcttcgaccacatgcaccgcttcatggccgccctggtgatccgcgccggcggaagcgtcgaggtggtcaaggtcaaccaccgcccgcgtgaacgcggcacctccaaatacggagtgtggaaccgcctgtgggtgggcatcgtcgacctgttcggcgtgatgtggctgatgcgccgggcgcgcaacccggtcgtcgagtgccgcgagtgaccgccaagggtcaccatcccctgctcaatccccgcgccatggtcaagggactggtgctgatcgccaccctggtgatgatcggcttcctgctggaggggctggggctcaaggacgcgctggatacccattggatcgatgccgaggtcaagggcaaggggctgagcggcgacgccctgttcgtgatcatcggcgccctggccgtctgcatcggcctgccgaggcagggggtctgcttcctggccggttacgccttcggattcgccgagggcctagtgtggtccagcctggcctccatggtcggctgcatcatgacgttcttctacgcccgccagatggggcgaagcttcgtcacctcccgctttcccgagcgcgtcgcccgcatcgacgccttcctggccggcaacgccttcgccatgaccctgctgatccgcctgctgccggtgggcagcaacgtgatcaccaatctggcggcgggagtgtccggagcccggccgattccgttcttcctgggctcgctgctgggctatctgccccagacggtggttttcgccctgctgggcagcggcattcaggtggatccggtcttccgcatcggcgccagcgtggtattgttcgtcgcttccggggtgatgggcgtgtggctgttccgccgctttcgtcacggccggcatctggacgccgccaccgaggcggtcatcgaagaagatggcgacgaacccaatgaacaagcccgctaaagccctttgcctctgtctcggcctgatcggccttgccgcctgcaccccggaccagggatcgcccaccgtcaccgccccgccgcgcagctcggatctcagcttcgacgcccagggccgggtcgtgcggccgcgagcagagcgcaattgggacgactcggtgggcaagaaggttcagaccatgctggcccaggccgaccgcgaggccttcaagggagtttccgtccgcgcctgggacggcggcgtgctgctgaccggcgccgtggccaagcccgaccagcgccgccgcgccgccgagacggcccgcagcgtcgagggcgtcacccaggtctatgacgatctggtcctggccgagaatccggcgcaccccatgtatatccccgatcccaatctggaacagcggatctatgccgggctgctgggcgaagacgcgatcaccggcgcttatacggtgcgcgtggtcaacggcgtcgccttcctgcagggctccacccgctccaaggccgacgccgacaaggccgccgacttcgttcgcggcttcgacggcgtcaaatgggtggtggaccgcatttcggtccgttgaccatcgtttagccgcaatccggagccagggtcgaggggttgaccctggagccccgccccatgtcccgtcgcctcgccctgctgcttgccgtatccgcctccgtgaccgcctccgccgccgaggtcacggtgccgcccgaggagcgctcgaccctttcgctgagcctgcaccaggatggtccggccctgatccgcgaccgccgcccggcattcctggaaaaggggctctccagcctgatcctggacggcattccccgcaccatccgaccgggcagcgccaccatcgaaggacatggcctgaccgtcaccgagcgctggatcgaccccggcgccctgtcggcggagcggcaattggcggcccatctcggccggacggtctcggtgatctgggacggcaacggcccggcccaggccgccaaggtcctggccaccgagggaacgccgctgttcgaagccgacggcaaggtggtggcgggccggccgtcgcgcatcgtctatgacggactggcccccggcctggggccgcgcccggccctccgcgctcaggtggaggccgaagccgccggacggcgcgagttggaactgtcctatgccgccgacggtctggcatggtcgtcccaggccaatggcgagttgaagggcgatcaattgtccctgaccatctgggccgatctcagcaatgccagcggcgccgatttcaccgacgccaccctgcatctggtggcggggcggcctcagaccggcggcggcgcccccaagatgatggcccgcgccatggccgaggcggcccccctgccgtcgcgcgaggcggtcggcccctatcatgtctacaccttgccccggccggtcaccctgcgtgacggcgaaagccggcaggtgcccctgctgccgccggcccaggtgagggtgagccgcgagctggttctggaatcccaaggcgccaatgccttcctgtcgcggtcgctggatgcgcggcctcagcacccggtgctgcggctcggcttcgccaacaccgccagggccggactgggcaagcccatccccgccggccccatccgggtgaccatgcgcggtcccggcggcgacccggtcctgctgggcgaggacatgctgcccgtcctgcccgaaggggccgaggcccgcctgaccctgggtcaggccttcgacctcaccgccaggcgggtccagaccgactaccagaaggtctcggccgaggtgacggaaaccgcctgggagatccggctggccaatggcggcgaacggccggaagccgtcacaatccgcgagaccttccgctccgactggctgatgctggaagagagtgcgccccacgccaaggaaagcgccagccaggtgcgctggctcgtccaggtcccggccaagggcgaggcggtgctgcgctatcgcgtcaggatgaagtagggagaatcaggccacccgctggcgaagagcctcgagctgttcgcgaatctcgtcgaggcggaccaccatggtgacgatccccagttgctcttccacctgattgcgctcgtccatcagcgcctggcgggcaacggggtcggcggtctgccagcgaacgttcatcccctcctcgtattcagcgaaggtatgaagcgccgcgtccagctcgtggtcgagccggtttttttcttcggtgagagtctcgatcatggccatcacgtcatccacgaaacaatcgtcgccgcccgctaggcggcgagcctctttctgggatcaagcgcctcgacctcggcgcgggcggctgcgtcctcgacgccggtgaccgccgccagcagcatggctgcggccgtcagtccctcggcgtgggcgacaccggctccttgcccggcggccaaggcatcctgaacggtctcgtcataggcggtcaacaccatctccaatgtggccgagtccatggacgccccctttcaggtcgcttcgcctcatccctgtgacgaggatcttcctggacgatagtatgtccaacggaatcagatccgcaatagcataatgcccgcattacaaatgggattattgtaatgactgggcctttattaagcacttttattaaacacatcatgaatggattgtaatagccgctttgaccgcccgcggcccaactcacccccgccatggcgaaggtatgcgccgccaggagcgtgtccggcttcagtcaatccaggtccgcccggcctcacgcctggaggccacggctccaaacctcattcttgcctattgataaaaacaaagggggaccggggcatcgcgccctaggcgggtgcgggcggcagcccgccttgtcatggaccagagttaacgccggtcacttcagtgcgccgcaccccaggtgtcggcgatgccggcttccaccagcagggggacggagaggctggcggcagcttccatgacctgcttgaccaccgcgacggtggcgtcggcctccgcctcgggggcttcgagcaccagttcgtcatggacctggagcagcagccgggccgacaggccggcagcggccagggcggcgggcaggcggatcatggcgcgcttgatgatgtcggcggccccgccctggatggggccgttgatggcggcgcgctcggcgaaggcgcgcatggcgccgttcttgtccttgatgcccggggtgaagaccttgcggccgaacaaggtggtgacgaagccctggtcgcgggcctcttccttggtccgctccatataggcgcggatttcgggataccgggcgaaataagcctcgatataggccttggcctcaccctgggggatgcccagctgggccgccagaccgaaggcgctgataccgtagatgatgccgaaattgatggccttggcccggcggcggagcgccgggtcgatcccgtccagcggcacgccgaacacctgtgacgcggtgatggcgtggatgtcggcgccatgggcgaaggcatcgcgcaggccggcgatctccgccacatgggccaccagacgcagttcgatctgggagtagtcggcgctgaccagtttcttgcccggttcggcgacgaaagcgtggcggatcttgcggccttcctcggtgcggatgggaatgttctgcaggttggggtccgacgacgacagccgcccggtggtggtggccgccagggaataactggtgtggacccggccggtggccggattgatctgggccaccagggcgtcggtataggtgcccttcagcttggacaactggcgccagtccagcaggcgggcgggcagcgcatgcaacggcgccagctcttccagcacgtcggcgccggtggcccattgcccggtcttggtcttcttgccaccggggaggttcagggtctcgaacagcaccttgcccagttgctgcggcgagcccaggttgaaggcctcgccattgttgagggcgatgacctcggtctccaactcggtcaggcggcggccgaaatcctcggacagcgccatcagctgggcgcggtcgaccttgatgccgtcgcgctccatggcggcgatcaccggcaccaacggacgttccagcgtctcatagacgctgaccatgcgctcggacaaaaggcgcggtttcaacagcgcatgcagccgcagcgtcatgtccgcgtcctcggcggcatagtcgcgggccttgtccagcggcacccggtcgaaggtcacctgattgcgcccgctgccgcagacctcggagaacgggatgttggcgtggccgagatgcagcaggcacagctcgtccaggccgtgaccgtggctggccccgtccagggcgtaggacagcagcatggtgtcgtcgaagggctcgacggccaggccctgcatggccatcacctgcatgtcgtacttgatgttgtgcccgaccttcagcaccgaaggatcggccagcagcggcttcagccgggccagggtctcggcggcgggaatgatctggggcgcgtcggtcgacgggccgcccagcaggtcgccctgggcctgggccggggcgtgcagcacgggaatgtagcaggcccgccccggcgccaccgccagggacacgcccaccagccgggcgcgcagggggtcgaggccagtggtctcggtgtcgaagcccaccagcccgcccccggtggccagggcgatccagttttccagcgctgccagatcggtgaccagctcgtaggcggtctccaccttgggcggcagggacggcgcctcggccggagcctcggtgggcagcaccgcccgcgtggcggtgggagcggcggtgggaatcttggcgtttaggcggcccatcagcgagcggaagccctgggcggcgcagaaggcggccagcttttccggcgccggcggcttgacgtccagctcggacagcggcaccggcaccggcgcgtcggtgcgcagccgcaccaactcgcgcgagatgcgggcgagatcggcattggctatcagggattcgcggcgcttgggctgcttgatctccgacgccctggccagcagggtgtcgagatcgccgtattcctcgatcaactgcgccgccgtcttgacgccgatgccgggcacgccgggcacgttatccgaggaatcgccgcacagggcctggacgtcgaccaccttgtcgggggaaacgccgaacttttcccgcacttcggcctcgccgatggtgcggttcttcatggggtcgatcatctcgacccccggccccaccaactgcatcaggtccttgtcggacgagacgatggtgaccctggcgcccgcctccaccgccagacgggcataggtggcgatcaggtcgtcggcctcgaagccttccagctcgatggccggcaggtcaaaggcccgcgtcgcctcgcgcaccagcgggaactggggcaccagctcctcgggggcgggcgggcggtgggccttgtattcggggtagatcgcgctgcggaaggtcttgcgcgacgaatcgaagatcaccgccacatgatcggaggacgagtcggccagcagcttcatcagcatggtggtgaagccatagacggcgttcaccggcgtcccgtcggcccgggtcatgggcggcaggccgtggaaggcccggaagatgaagcccgagccgtcgatcagcgtcacatgccggggggcttcgcccacctcagtgatgaccgatcttggcgccttcggccagcacgtaggtccgcgagcagtaagggcaaacgatcttgccctcggcggtcaggtcgaggaagacgcggggatggccgaggccgttggccacgtcgccgtcacaggcgaccttggcggcggaaacggtgacggtgtcgaaagcgggctgggtggaagcggaagacatgggtgctccgttgaccgaggtgttggccggatgatacccattggtggccatggttcaatcactctctcatcccaccctgcccgaatcggcagtggaagcccactccctggtcaaggtctacaagggccggagcggggaaaagcgcgccctggacggcgtttcgctgtcggtgccgcgcggctcgttctttggcctgctgggtcccaacggcgccggcaagagcaccttcatcaacatcatggccggtctggtgcgcaagaccgagggccgggtcagaatctgggaccgcgacatcgacgtggacgccaggggcgccaaggccgccatcggcgtggtgccgcaggaactgaacctggaccccttcttcacgccgcgcgagttgctggacgtccaggccggcatgtacggcgtgcccaagtccgaacgccgcaccatggaaatcctcgaagccgtggggctggccgacaaggccggagcctatgcccggaccctgtcgggcggcatgcgccgccggctgctggtggccaaggccatggtgcacgccccgccggtgctggtgctcgacgagcccaccgccggggtcgacatcgaactgcgccagcaattgtgggcctatgtgcgcgagctgaacgccaagggcaccaccatcttgctaaccacccattacctggaggaagcggaagagctgtgcgaccgcatcgccatcatcaaccatggcaagctggtggcctgcgattccacccccaacctcctcaagcgcatcgacggcaaggccttgaccatcaccctggccgccgatctggcggagatcccgccggaactggcgccgttcgggccggagcggctgggcgggcgccgcctgctgttgcgctatcgcccctcggccatgcccatgggccgcatcctcgacgccttcgccgccgcccatctctccatcgccgacctgtccaccgaggagaccgacctcgaggacatcttcctgcaactgacctcggcgaagtaatgcgcatccgcgcctcgggggcgaaataatgcgcgcccgcgcctcggggatcctgggaggcctgctgatggggttgctgctttccgcctgcgccgccagcacccagccggcgggaccggacatccgtcccgccgccctggaggatggggccatcgtcaccggcgacggggcaaggctgcctctgcgctcgtggctgcccaccgccgcgcccaaggcggtgatcgtcgccgcccatggcatgaacgattattccaacgccttcgacggtccgggcaagggtctggcggcccaggggatcgccgtctacgcctatgaccagcgcggcttcggccaggccccccatcccggctggtggtcgtccaccgagaccatggccgccgacctgcgcaccgtgtcgcgcctgctggccgcccgccacggtccggcgccgctctatctgctgggcgagagcatggggggcgccgtggtcatcgaggccaccgtccacgccccgccgcccgaggtcagggggatcatcctgtcggcgccggcggtctggggccgggccagcatgccgtggtaccagcgggccgccctgtggctgagctacaaggtcgcacccggctggacgctgaccgggcgtggcctgaagatcatgccgtccgacaatatcgagatgctgcgcgccctgtcccgcgaccccctggtcatcaaggaaacccgggtggacgccattcacggcatggtcgacctgatggatgcggcgcaacgggatgcgccgaggctggacctgcccctgctgctgctttacggcgcccatgaccagatcatcccgcccgaacccacctgggacgcggtggcggccctgccccatctgggaacccgccagcgtgccgccctttacgccaatggctggcacatgctgctgcgcgacctccaggcccaggtggtggtggacgacatcgccgcctgggtggccgaccagaccgcccccctgccctcgggagccgacagggctgcgtcaggaaagcttgagacccttgcagcggagacccgatgacggcgcgccgtcgccgtgccatacttcgctgctgcacaatggattggcgcaccccatgacggctcgtttctggattcccgcattcgtcgccgccctgctgctgggtgctggcacggcctcggccgaccccaaggtggtccgggcgctgggcgaggacctgccgcagccgggagcccaactggaagacgtgcgcaccatgaagctggcccccggccggcgcatcgtctgtgaatccgacctggaaaagcccaagctggccaatcccggcctgatgcaggcccagcgctcgcgcggggccgatcatgtgcgccgctgcgccgtgttcgccgacgacggcaacggcacctgggccctggccggcgtgccgacggtgttcggcgaggcgcggctgtggctgatcttcgtcgagcaaggctcgcagggccgctaccgcctggcccagttcagcctgtggggccgcaattccgaatgggacaaggccgccggcctgttgggcgccatgctgggccagcccggaacccaggccgagcgcatgctgggctggaaggacgagcagcacgagaccctgatgttcatcgacgacaagtacccggaccagttcgccatcgccgtgggcgacgtccggctgcgcaagttgatgcgatcccccggaacctccaatcgcgagtagccgcccatgcgccttgccgccctcctcggccttcttctgctgagcctgcccgcctgggccgccgacaccacccggccgctggagctggggcaggcccagttgggtatgcgcgccaaccagctgcgctatgccgccctgcccgccaacacccggatggtctgcggctgggatgccgacaagccgccgggggtggagaagaccccgctgatgatggtgggcgccatggtcaccgccaaggtggaccgctgcgccctgttcgccgatgacggcaagaacaactggagcccgcgccccactacggtcggcggcgtgcccaccgaattgtggttcatgaccatcgaggacgaggccggcagccagcgcatcttccagatcgtcggccgccaggacgcggacaagttccccaccaccttcgcctacctggccgagcgctggggcccgccggtccagaaggtgccctattacgtccgctggctgaacggcaccaacgagggccagatgaaggaaagcgaagagggcgtcatgatctggctgttcgacaccaagctcttcgccctgatggaatcgcgcatgccccggggcaagtccaagaagtagcccccggcactcagggacaaccgcgcagtgaactctgccggttgatggaggcgatccgccgttccccgagatcaagggatttggccgccgcccgccggtggtcgagcaattcgcattcagcggcgatcaggaccttctggtccgacttggtcaggagggcatggtaccgcccggccgatgggtcgccctgccgcttggccgccagataggcctggtgccatttggcatactggccgttgcccaccagcgacatgaccacctcggcggcggacaggttcccgggcttcaaggggaagcggatgtatccgccgggggtgtccggcgattgcatggtgtagattccgatggtgttgtcggcgacctcgttggtccgcttgccctcgggaacgggcagacagcgcaaatccttgacctcggcggccagagcgcgctgcttcggcgccagctccgccgtcatgtcgatggccttgcgcaccagggcgacgcattcgccggcctggtcacccgcctccgcctggattttccgccccttgtactccaccgattgcggagcagcgatggcgccggacgcgaccaaaagtcccacggcggcaagccctgcccatgccttcattttgtcctcccccatggtttcgcctggctctcttcccccccgggggggcaaggcgaatggccgcaatgatgcggatcggcgaatgagggatcaatgcaaccgcacgatctacccatgattgcgccaaagagcatagtctccgccttcatgccgccgcatttctttggcacgaataagctcatgagcaaggaagccgcccttttcgccctcacccgcttcgggatgggcgccgcccccggcgaggtcgccgccatcgccgccgatccccgcgcctgggtgctggaacaactggaccatccggccgtgccgccggaattgtccggcctgcccgatcacgccaccacgcttcggcgcatggaggagatcaggaaggccaagaagaccaatcccgaactgggcaaggaggagatgcgccgcctgttcgtcgcggaagcggcggcccgcacccgtgcggccatctcgtcgcgcagtccggtggtggaacggctggtccggttctggagcaatcatttcaccgtctcggcccagcgtcatcatgtggcgcccatcatcggcgccttcgagcgcgaggccatccggccccaggtgctggggcactttcacgacatgctgcgcggcgtggtccgccaccccgccatgctgggctatctggacaacgcccagtccatcggccccaactcgcccgccgggcaaaagcagcgcaaggggctgaacgagaatctggcccgcgagattctggaactgcacaccctgggcgtgaacggcggctacggtcaggcggacgtggaagccttcgccggcatcctgaccggctggaccatcgatccggcgggaggcttcttccgctacgtccccaaccgccacgagccggggccgaagcggctgctgggcaagagcttcgacggcggcgaaatggaggccgagcgcgccctgctgatcctgtcgcgagacaaggccaccgcccgcttcgtcgccaccaagctggcccggcatttcgccgccgacgagccgccgcccgccctggtcgacgggctggcccgcgccttcctcgacaccgacggcgatctgctggcggtgacccgcctgctggtcacccgcaatgagacctgggcccagcccctggccaagctgcgcagccccgaagatctggtcgtcgccgccctgcggctgaccggcatcgaaggcggcgaggatttcgaccgccgtctggttcagtccctcaatctgctgggccagcccgtctggtcggcgccgtcaccggccggctggcccgaccgggcggaaggctggatggcaccggaagcgctgatgcttcgcctggaatggctcaaggccctggccgaccgccggggcaaaggcgtcaccgccgccctggccgagcaggtgatcgccgccggtcccgccacccgtcaggccctggccggcgccagcgggtccgaagccctgttcctgctgctggccagtcgggagtttcagaggagatgagcatgcacctctcccgccgcgtctttctcggcgcgaccgccgctctggggttcattcccgccgccctggccgccccggtggccgagcggcgtctggtggtgatcgtcctgcgcggcggcatggacgggctgcatgccgtgccgccgctgggcgatccgtcctacgagacggcgcggggcggcatcgccctcaaggcagagnccgccccgcgcctcgacgccaccttcgccctgcatccggccctggcgccgctgcagcccctttggcaggcccgcgagttggcggtggtgcatgcggtggcctcgccctatcgcgagcgttcccatttcgatggtcaggatgtgctggaatccggtggcgcacggccccacgcccttcatgacggctggctgaaccgggcggcggcggccctgggcaatccgcccgccctggcggtgagccaagccttgccgctgctgttgcgcggtccggccaaggcctcgtcctgggcgccgtctccgctgcccggcctgccgccgacccggctggccgccctgcgggcgctttacgccgatgatccgctgctgtccatggccttcgaggagggcgtccagatggactccctggccaccgaggccctggccgccgagccgggcatggcgggaggagcccgcaaggtcgccaacgcctttcccgccctggccggcgccgccggcagcctgatggccgcccccgccggcccccggctggcggtgatggaactgggcggctgggatacccataccggccagttcggccgcatggcccagcccctgggccagttggccgagggcatcaatgccctggcgcgcgcccttggccccgcctggaagaccaccatggtggtggcggcctcggaattcggccgcaccgtcgccgagaacggcaccggcggcagcgaccacggcaccggcggcgccatgatcctggcgggcggccccttggcgggcggacgggtgatcgccgactggccgggcctggacaaggcacagctgcaccagggccgcgacctgcggccgaccctggacgggcgttcggtgttcaaggccatcctgcgcgaccatctgggcctgtcgcccaaggtcctggacggcgccgtctttcccgacagcgccgccgccacgcccttgaatggactgatcagggcctgaaggctccgatcaggcggtccccagccggtcgagaaaggattgcagcagatcgatctgcctggtgcgggtttcatgctgccaggactggtcatacttggacgacagcttggcgccgtcgatggtgcgctggacgagaccggcgtaatcggcgtcggggccaagataggcgttgccgccacccgcctccggcaggctgcccaccaggaagctgccgctcagcagcatcaggtcgccgtcgctcagattcgccgtggcctccttccaggcctgcttgacgctggccggggcatcgggtggcgggaagtgggaggtcttcgccgcgccaacctcctcgaacccgtcgtgatcgaggtcctgggcctgatccggcgcccgcagcaggttcgacgccccctcctggctgaggctgccgacctggatgggattggccaggcactggatggtctggaccgccttcaactccgacggcgacagcgattgcaggaaggccttggggtcctctaagccaccacaggacgccgccttggtcagcaccgcctcgaaggcggccgagctgtcttccacctgctggcgccggtcgtcgccgatgccgtgcttgaagtagtcggtcttccaggcgcgaaaatcggcgatgcggctgtcggctgccgtgggctccgattgcagcaggtcaatgggcagcgaggccgccgggctggtggtgccgcccgccccttggacagccgtgccgctcgcggcagattttgccgccccgccgcccgtcgcggcaaggagtgccgcccggaacgccgccgtcgcgtcaccggaggaaccgtcgccaacgcgctgattttccgtccggatctctgaacggccctggatattcgtgagcatgatgacgcccccggttgcagtcatgtcggggggtatcaatgcacgcggcgcgccaaccctggggggcgcgaaggaccggggcggccgccctgcctaacccggctacacgttcgacagcccgcccgagtgctggttgtgaattagcgccatgaattcccggcgggtagcggggtcctcgcggaaggcgccgagcatgcggctggtgaccatggtgacgccgggcttgtggatgccgcgggtggtcatgcactggtgggcggcttcgatgaccacggccacgcccttgggctggagcacgtcgttgatggtattggcgatctgggccgtcagcttttcctggatctgcaggcggcgcgaatagatctccaccacgcgggccagcttggagatgcccaccacccggcggttgggcagataggccacatgggccttgccgatgatcggcaccacgtgatgctcgcaatgggattccaggcggatatcgcgcagcagcaccatctcgtcgtagccgtcggtttcctcgaaggtgcggtgcagaatctcggtggggtcctggtcgtagcccgagaaaaactcctcgtaggcgcgcaccacccggtcgggagtgcccaccagcccctcgcggtcgggatcgtcgccggcccagcgcagcagggtgcgcaccgcctcctcggcctcttcccgcgagggcttgtccaggcgggagccggtagcggggagaagctccctgggcagggtgagagaggtggcgtccttgctcatggcggctttcctttcgcggtggtcacgatcgggcatgtggctgcgcctttcggattttacaagcccggctagttcagccggggcttctcgtgcgggctgtccagggagaaagcgggaatggcgatgtcgaaggccgagccgtcctcgtcctccatctcgtaggtgccgaccatgatgcccgacggcgtcggcagcggggtccccgaagtatattcataggcgtcgccggggcgcagaacgggctgttcgcccaccacgccggggcccttgacctcctgcacccggccgatggcatcggtgatgacccagtggcgacgcaggagctggacggtgcggctgcccttgttgacgatccgcacgcgataagcccagacgaagtggttgtcgccgggcgaggactggtcgtccaggtagaaaggcttgacggtcacctcgatgtctcgggtggtctggctgtacatgaagatccccatgcggaacaatgccgatacccatcatatcaggtgggtatcggcctttgtccatggacagaatcgatcggttctagccttccagcgcccggcccaggtcctcgaccaggtcgtcgccgtcctcgaggcccaccgacagacgcagcaatccttcggtaatgcccatggaaagcttgtcctcgggcgacaggcgctggtgggtggtggtccagggatgggtgatcaggctcttggcgtcgccgagattgttggagatgtcgatcaactcgacaccgttcagcagcttgtaggccgccggcttgccgcccttgagctccagcgcgacgatgctgccccagccgcgcatctggcgcttggccagatcgtgctggggatggctttccaggccggggtagagcacgcgggccacctcgggacgggcttccaggaagcgggccaccttcagggcgttggcgcaatgacgctccatgcgcaggtccagggtctcgagccccttgagcagcacccaggcgttgaacggcgagagggccgggccggtgttgcgcaggaacggccccaggatgtcggcacagaattccggcgagcccagcaccgctccccctaagcaccggccctggccgtccatgtgcttggtggcggaatagacgacgatgtcggcccccagttccagcgggctttgcaggatgggcgtggcgaagacgttgtccaccaccaccttggcgccggccttgtgggcaagctcgcacacggcggcgaggtcgatgatctccagggtcgggttggagggagtctccaggaagacacaggcggtgggccgggacagcgccgcttcccaggatttgaggtcggtgccgtccacgaacacccgctcgacgccatagcgcggcagcaactcgttgatgatccagtgacacgagccgaacagcgccgtggaggccaccacccggtcgccagctctaagctgacacagcagggcggcgtgaacggcggccatccccgaggcggtggcccgggccgccacggccatgccgggcggcgcgccttccatctcggccagacgctgctcgaacacggcgacggtcgggttcttgaagcgggaatagaccatacggtccaaggtgccgtcgaagctggcctcggcctcctcggcgctgtcgtagacatagccggaattcatgaacacggcttccgaggtctcgcagaaattggtgcgggacaatccaccgcgcacggccctggtgcgggggcgccaagtgcgggacggcttggaatcgttgctgttcataggacctccgaagacaaaaaccccgaccatggagtgggccggggctcgactggcggagcgctcggacctctttagcgggatgttttacgtggccgcaatccggtcggacaaatcaccacgcttcgagtcatagcgccgggcgtggccgagcgtcaagtccattggcgaaccggcgaacactcaatgttttccgaatattacggttgtgcgaaatgcagggcgcggctggtcataccgcttgaagatatgcaaacggcaggtctatgctgcgatgcagcaaagcatattggagagtcagtcatcatgaacatcgacgcgaatgccgccccggccccgctgaggcttctcgatcttcgcggcaagaaaggattgatcatcggcatcgccaacgatcagtccatcgcttacggcatcgccaagcattgccacgcctatggcgccgaactggccatcacctatctcaacgagaagggcgacaaatacgtccgccccctggccgagggtctgttcgcccccatctacctgccctgcgacgtgcgcgaggacggccagctggaagcggtgttcaaggccatcgaggagaagtggggccgtctggacttcgtcatccattccatcgcctacgccaatcgcgatgacctgcacggccgggtcaccgactgctcgcgcgagggcttcgccctggccatggacgtgtcgtgcttctccttcgtgcgctgcgccaagctggccgagccgctgatgaagaatggcggcgccctgatcaccgtgtcgttctacggcggccgcaaggtggtcgagcactacaacgtcatgggcccggtcaaggccgcgctggaaagcaccaccaagtacctggcgcacgagcttggccccaagggcatccgcgtcctggccctgtcgcccggcccgctgaagacccgcgccgcctcgggcatcgaccgcttcgacgagctgatggacgccgccgccgagaaggcgccgacccatcagctggccgatatcaacgattgcggctcgttcgccgcctatctggtcagcgatctggccaagtcggtaaccggcaccaccctgttcatcgacggcggcgcccatatcgtcgggtaattaagttcggacggtccggcccggcctcatctccgctccggcccggccggaaccaagcctggaggcgtcgcctcccgccagcagccagtaccgttccagggactggtccacatggccgagaatcgccccgtcgatccgcccctccgaaaccatgccctccatgatgggcatcagctcggcgggcagcagggaggcgcggtagggccgctcctgcaccagcgcctgaaagatgtccgacacggcgatgatgcgcgccggcagtggcagagcctgggccgaaagctggaatggatagccctctccgttcagggtttcgtggtgaaacgccgcccattgcgcgatggggttgtctccgaacaggcggaacagcacgtcgtatgtgtcgaaggcatgccgcttcatcagcacccgctcgtgcgggtcgaggggcgtcgccttttccagcaccatatccggcacccggagcttgccgaggtcatggagatagccggcgatctccaccaaacgcacggtctcggcatcgagccccatgtcaccggcgatctgcgcggccagcgccgccaccttttccgaatgccgggcggtgaaggggctcttggcatcgatgatccgggcaaacatcacggccagcgaccggagttcacggtgactgatgggccgggtcaggtgatggacgcccatgtcgtgcagatgggtgtccagaagttcgggcgactgggtgaaccagaaggcctccgactgggcgcatctctccagagcggctaccagttccggcttgaacaggcttcccgagtgccgccggagaacgccgaggaagccgcccttctcctcgaacgccgccggggaatccatgccggcgcgcagcatgtccaggcggtcggccagaaagatcaggttggtgtcttccctaagcctgggctccagccccatttcgcccagccggctccagcgcgtgtggtggaagcgcaccatgggcgccagatgggccagcggcggcacgtcgcgcagcagcccctcgcccctcaggcaatgggcttcggcattgctccattccagctcggtgaccagatggccgtgctcgtcggtggtcgacacgccgcaatcgtgcagaaacgaggcgaacaggatgtcgcgccgccgctcctcgtcccagcccaagtccctggcgacctgcgaggcgatgaaaccgacgcgcttgccgtgctgcaggtcatcgatcccgaccagatccaccgcccgggacagggcgtcgacggcgcgaaagagattgatggactggaccatggccatctccaccggaaaatccccaccggccattgtcccgtgtcgcgggatcgcggtccatccacataaggcgccatgctcatatggcgagtttggggttgcttttgccgtcagcccgtccaggcgacgccctgatcgcggtaaaagcgcagccgcgcctgatcgcggatcaggaaccggtcccccgccaccccctcggccggcagggaccggcggcggcgggacagatcgtcccgctgatcggcggccagggtctgaaagaacagcgccctcgccgcacccgatgggcgcgaagcggggtcaaagggcggaatgggaccatcgtggcggcgctcggccgcgtccatccgccgaaaggcaaagcggacaggcattccgttctcctcggcacgatggagaacgaagagaacacaacgggaactgatttgcaagcgctactggcttgaccacaggatgcgggccatccaggccacctcctcggtggcgagggagcgcccgggatgggcgggattgatggagcccaactcgatgcgcctggcggtctggcgcagcaactgcttgaccatgacctcgccctcggtggtgcggaccaccactcggtcgccacgccgcaccccggcggccggcgagacgatgaccacatcgccatcgcggtaaaggggttccatggaatcgccgctgacctccagcgcataggcatgggggtcgccgatttcggggaaggggatttcatcccaactgccgcccacgggatagccggcatcgtcgaaatagccgcggtcgcccgcctgggcaaagccgaccagcggaatggtgctggcctgattgtggggctgggccaggtcctcgatataggcgacgaaggcggtcatgctggcgcctgtcgcctccaggaccttggcgacgctttccgtcgacggccagcggggcttgccttcgcgggtgatgcgcttgctcttgttgaaggtggtgggatcgagccccgccttccgcgcaagggcagacgccgtcagcccgtggtcacgggcaagcgcatcaatggcggcccaaatgtcggcgtgcttcagcatgggaagatggtcccgcaattcggccccgggttccacaggaacataaacctttttattgactctattcggccatatgcgggacaactatcggcatacgatcctagcatcggagaacttaaatggctttaaaacggaacatagcgccaacactcgacagcaggaaggaggagcccttcgcaactcccgaggatgcctgggcgtggtactcccgctgccagttggcccgcgacgaaggagcccgctttcagacgggattgggcgatatcgcccgcccctgcgccccggacgatatcgcgcgggaacttcggcgcctttaccgcagccgcgtcctgcgcggcgcccatctgcgggtgctggcccgcttttccggcgagaccggcaccactgccgacgacgacagcggcaccggccgcctatggcgggaggccttggaccggctgggcgagcgcttgcgcgccaagggaatcgtcgcatgacccgcgccctggtggtgttctccggcaaggccgacctgctttggctgcgcctgctgcggcccggctttcgccactgcttcatcctgcttcacctgggcgacggctgggtctgcatcaatcccctggcccatcgcacctcggtggaggtctggacacccgagcccggccaggacctgccagggtggctccggtctcaggacggcctgaccgtgatcgagaccgaagtccgcaacccaccccatcgccccagtccccttgggctttattcctgcgtggaagcggtcaagcgggtcctggggcttcaggagcggtgggtgctgaccccggcgcagcttcatgactttctcacccgatgcggaaaaaagtccttgacttccgaagttaataggaccaatgtccagccatcaacgccagagccatgcccaaattaccgccccacctcggcggaaggctttcactcgaaaagcgttgagaacaaaccatgatcaatgagcaaaggagatatgccatgggtggttttttctcgcccgatccgccatcgcccccggccccggtggtgctgccgccgtcgaccagcgccgaggacagcgccacggcggaccggcttgacgccatcaaccgcaaccggcgcggcctgctcggcaccatcgccacctcggaaaccggagtgctgcaatcgtcggcctcgggcaatcgggcggccaagaccttgctgggagagtgaccatggccagcaaccaatccccccgccgcgaggcggccgaggataaggccgccttgggcgaggtcctgctgggagacgagggctgcgacccgtccttcctgctgcggcgctatcgcaaggccaaggaacggcggagcacctgggaatcccactggcaggaatgctacgactacgccctgcccctgcgcgacggcatgtttcattccagcgtccccggcgagcgcaaggccgaccgcctgttcgacggaaccgcccccgattgcgttgaccagctggccgccagcctgctgtcggagctgactccgccctgggcgcagtggttcggactggccgccggcgaccagatgcccgaagcggaccgggaccaggccgcgccgttgctggaacgcatcgccgcggtgatgcagtcccatttcgatcgctccaacttcgccatcgaaatgcaccagtgctacctggatgcggtcaccggcggcaccgcctcgctgatgttcgaggaggcgccgcccggcgagccgtccgcctttcgcttcacctcggttcccctgggccaagtggtgctggaggaaggcccggccggacgcctggacgtcaccttccgccgcagcgagctgtcggtcgcggcgctgaaggcccgcttcccccgggcggtcctgccccgggaggtgatcaaggcggcggccgacgaccccgatctgcgcctgggcgtggtcgaagccgtggttccggtccgcggcggctattcctatgccgccgtgctggatgacgacggatccgacctggtcctgggccgggggcaattctccagctcgcccttcctcaacttccgctggctgaaggcccccggcgaagtctatggccggtcgccggtgatgaaggcgctgcccgacatcaagaccgccaacaaggtggtggaactggtgttgaagaacgccaccatcgcggtgaccggcatctggcaggccgacgacgatggcgtgctcaaccccgccaacatcaagctggtccccggcactatcattcccaaggcggtgggctcggccggattgcagccgctgaccgcgccgggacgctttgacacctcgcaactggtgctggacgatctcagggggcgaatccgccacgccctgatgggcgacaagctgagccagcccgcctcgccggccttgaccgccaccgaggtgctgcagcgtgccgacgacatggcccggctgctgggggccacctatggccgcctgcagagcgagctgctgaccccgttgatcctgcgcgccatccacatcctgcgacggcggggcgaaatcccccccttgcaggtggacggccggaccatcgacctgcagtaccgctcgcccctggcccagaaccagggccggcgcgatgcccgcaacgtgctgaactggctgggcgccctgtccagcctgggaccgtcggccctggccaccgtcgattccgatgctgccgcccgctggctcgccagggccttcaacgtgccgtccgagctgatccgcgcggccccggtgcaaccggccgccgccatcacccccgatcccacggctctgaacgccctggtccagaggctcgatgcgccgggcgcgatccaggccaagcccaagggtccgacccatgtccccgggtgacgccggctggacctggctggacctgtcgccgccgggaccacacggcgatcaggacaccctgctgctggcccgtcaggccgcccggctgttcgccacccccgatggcgaagccgtcctgcagcacctgaaatccatgaccatcgatcgctgcctcggccccgagtccggcgacaacgcgctgcgccatctggaaggccagcgacatctggtcctgcacctcctcgccctggccgcccgcggccgggccggagcgtagggccttcacccaagcaccacaggagttcatccatgttttccgagtcctcccttccgcccgccaacgccgaccagtccggcgagggcggccgccccgagaatgtcccggccaagttctgggacgccgccgccggtcaggtgcgggtcgacgccctgctgcgggcctatcgcgacctcgaacgccgggcgtcgtccatggtccgggttcccggcccccaagccccggccgaggacatcagcagcttccggcgggcgctgggcgtccccgacagccacgagcagtacgccatcgcctcaacccaccccgccctgaccagcgatccgaaggtcaatcagcgcctgcatcaggccggcttctcccaggcccaggcccaggtggtctatgatctggcccatgaatgcctgctgcccctgatccaggacctggccgccagccaggaccagaccggccagatcgagcacctgaaaagccatttcggcggtgaggcccagtggcaggaaagcgcgcgccagatcaaggcctggggcaaggccaacctgcccaaggcggccttcgacgccctggcctccaccgccgacggcgtcaagaccatgcatcgcctgatgatgtcggaggagccctccctcggcgccgcagcgccggccggcgataccggccgcaccgaggatcagctgaagaagatgatcaacgatccccgctactggaagaccaaggacccggccttcatcgccaaggtcagtgacggcttccgccggctgtacggggaatagagtttttcgcacttaagccaaatcggacagtcgaaaaactctctagcccgagcggcacttgagccctgaaaaagcggagctttttcgtatagacagactcctggagtgcttcagcttgacgctgacgcactccaggcaagaaaaagcccccctcccggcggggaggggggcctgtttgtcccgagcctaccgcttcatggcggccacaccgctgccgatctcgaaaccggcgaaccagtcgatgaagcgcttcacgtcatcgcccttgaacaccaggccgtgctgcggcgccaggaagtcgatgtccagcttggaaacctgggcgcaccaggcgtcgcgggcctgggccgagcccagccagcgccggtggaaggcctccatgtactgcacatgggaggcgaaatcggccacgaacatggagccgctggccttgtccttgggaatcagggccgcgccgatatcgcccgagaacagcaccttggccttggggtcgtagacgttgaaattccccgatgaatgcaggtaatgggccggcacgaaacgcaggcggagatcgggggtcagcgaaatctccatcccctcgtcgggaatggtggtgaaggtggcctcacggtcgaaatgggcggtgaaactggaccacagccaggacaggtagatcttgatgtcgggctcgcagacccggcgccacagcggcagggacgagccgatatccgggtcctgatgcgacaggaacagcgccttgagatgggacaccgggacctcgcgggtcagcgccgccagcatggccggaaagacctccatcccgccgggatcgagcaagatggcgctgtcgccggaccggaccaggtactggttggtgtcgacaatattgtcgggcttgtccgggtcctggccaaacatctgccagcaatggtcatcctggcggaacagagtaacgcacttcatgggcggggtcctgactcgctatgagttgcggtggagttcgtcgagggcgtcaaggccgatgcgccgcaaggccgcacccttctcggcggcgcggcgaaccgcgtccgacgcctcgtcgatcatctggcgcaggtcgtccacataggtccgcatggtgtcggaaaccgtgcggaactccttttcgtgcacgccggcggcggccgcctcgatggcgatgttggtggcgatggaatccgactggctgaccacctcttccacagcgtgggttcgccgggccagatcgttcaccgcattggccatgccgtccagggtgtccaccagcatggacatcagatcggcgaaggcccgattgccacagtcgcgggaatgccttggaccggcatcctcgtccatcaggtgacaggcgcgctcgaacagattcaactgcatcagcgcccacaggatggtggacgagaaggcgaaggtccggccccgcagggagtgcatctcgccctggatctgggccagccggttgaccaactcgcgggtgtactgggtcaaggcccgcacggccttgcccttgtccccggcccggccggcggccagttccgcgttcaacgacaggatgcggaggttttcggccagttcgtccagatcaccgaaagcatgaaaggcgcggcggcaatcgccaagaacaccgttggcccgcgcctcgatccggtcagtgcgctgtgtccgtgtgcgtgtggtctcggaatgttgtgtcatgccccgcatgtccggcgaagaccctattcctgcggatgataatcggttttgcgccggtcggaagggggaaactgatccagtaccaacaatgcctgttcgccaccaaccccagcgcggacagatgagcgcaccagtttatcacaggttccccgccactccggggcgccctcattcaaaggagaacaccatgtccggatttgaagcaatgatacccatggccgctaccgtcgcctcgacggcggccggcatagcgggcaggtcggcggccgccgaacaggcggccgccgcccaggccgacgcccaggcgcgacagaaccagctgatccttcagcgccaggcggccgacgaacagcagcaacgcgacctgctggccaaggccacggcaacccaacgcgccaagatgggagccctgggggtggacggctccggcggctccgccgatgccatcctggccggcatgagccaggacaccgccgaatccatcgcctcgtcggcgcaagccgcccagctcaggctgcgcggctcttcctccgcgtccggttccggccccagcctgctcgacgccgcgacggcgggaaagtcgggcctgtcggtgttccgaaccttttacgattccctggattgaataaggttggagcgccaatgaaaacgggcgggaagtcgccttcccgcccgtccgtccgtgccttggccttgccgcgatcaggcggccttgccgcgcttcttcagcagttccaggatctcggcggcggccttggggatgttggtcccggggccgtacaccgccgccacgccggccttgtacaggaagtcgtaatcctgggtgggaatgacgccgccggtcaccaccaggatgtcgccggcgccctgggccttcaactcggcgatcagcgaggggaccagggtcttgtggccggcggccagggaggaggcggcgacgatgtgcacgtcgttctccaccgcctggcgggcggcctcttccggtgtctggaacagcggcccgatatccacgtcgaagcccagatcggcgaaagcggtagcgatcaccttggcgccgcgatcgtggccgtcctggcccatcttgcagaccagcatgcggggacggcggccctcggccttggcgaagtcctcgatatcggccttcagcttggcgaagcccgcgtcatccttgtacacgccgccatagacgccggagatggtccggttgacggcgcggtgacgggtgaaggacgtctccagcgcatcggaaatctcgccgacggtggcgcgggcacgggtggcctcgacggccaggccagcagattgccttcgccggtctcgcccgccttggccagggcggccagggcggcatcgcacttggcctggtcgcgggtcgccttgatctgcttgaggcgggcgatctgggattcgcgcaccttggcgttgtccacgtcgagaatctcgatgggggtctcttccgccggctggtatttgttgacgccgaccacgacctcttcgccgcggtcgatgcgggcctgacggcgggcggcggcctcctcgatcttcatcttgggcatgccggattccacggccttggtcatgccgcccagctcttccacttcctggatcagcttccaggcttcctcggccagagcgttggtcaggctttcgacgtagtaggagccggccagggggtcgaccacatggggaatgccggtctcttcctggatgatcagctgggtgttgcgcgcgatgcgggccgagaacggcgtgggcagcgcgatggcctcgtccagcgcgttggtgtgcagcgactgggtgccgcccagaacggcggccatggcctcgatggtggtgcggacgacgttgttgtaggcgtccttctcggtgaggctgacgcccgaggtctggcaatgggtgcgcagcgccatggacgaaggcttctgcggatcgaactgcttgatgatgcgggcccacagcaggcggccggcgcgcatcttggcgatctccatgaagaagttcatgccgatggcccagaagaacgacaggcggccggcgaactcgtcgatcttgagcccggtgcccagggcggcgcgcacgtattccaggccgtcggccagggtgaaggccaattcctgcaccgccgtcgccccggcttcctgcatgtggtagccggagatggagatggagttgaacttgggcatgttcttcgaggtgtactcgatgatgtccgcgatgatccgcatgctgggagccggcggatagatgtaggtgttgcggaccatgaactccttcaggatgtcgttctggatggtgcccgacagctggtcctgggagacgccctgttcctcggcggcgacgatatagccggccagcacgggaagaacggcgccgttcatggtcatggagaccgacatcttgtccagcgggatgccgtcgaacaggatcttcatatcctcgacggaatcgatggcgacgcccgccttgcccacgtcgcccaccacgcgggggtgatcggaatcatagccgcgatgggtggccagatcgaaggccaccgaaatgccctgctgcccggcggcgaggttcttgcggtagaaggcgttggattcctcggcggtggagaagcccgcgtactggcgcaccgtccacggcttggccgcgtacatggtggcgcggggaccgcgggtgaagggcgggaagccgggcagcgagcccagatgatccatgccttccaagtcggcggcggtgtagagcggcttgaccttgatgccttccggggtttcccagtccagggtcgagggcgaggcgcccttgaggtccttcgacgccagggcttcccaatcggaaacgctcttcttcgggaactcgctcatggtccctctcccttctgttttttaaaacgccgcgccacgcataagataggacgcgccaaattcatccagcgacttcaaccccgccaccgtggggcccagggtccgcaccagaccgtcggtcaggccgtagacccaggaatgcacttccagttgctggccgcgctgccaggcgtcctggatcaccggcgagcggcacaggttgcgcacctgctgcatgacgttcagctcgcacagccggtccacctgggccgcctcgttgggcagcatgtccaactcgtggcggtggcattcgcagatgtcgcgcaccgggcggatccaatactcggtgacgcccaggcgggcgtcctgcaacgccgcccgcaccccgccgcagccgtaatggccgcagacgatgatgtgctccaccttgagcacgtcgatggcgtattgcaacaccgccagacagttcatatccgcatggtggacctgattggccacgttgcggtggacgaaaacctcgccgggttccaggccgacgatctcgttggccggaacccgggaatcggcgcaaccgatccaaagatatcccggggtctgctgctctgccagatgggcgaagaagccgggcttggtacgctccgtctcctcggcccaggccttgttattggccagcaggcggtcgatccccgggactttgctcatgaggcgaactcgatgatcttctggtccaccgccagggaatcaccggaggccgcatgggtcttggcgaccgtggcgtcgcgctcggccttcaggatgttttccatcttcatggcctcgaccacggccagcggctcgccggccttgacctcctgaccggcctcgaccagcagcttgaccagcaggccgggcatgggcgacagcagatacttgctcatatccggcggcgccttgaacggcatcagcttgttcatcttggcggcgtgcggggtcagcaccagcacgtcgacccgcgacccggcatgggccaggcgcaggcccgaccccacccgctcgatctgcacggccacggcgcggccgtccacattggcgcggaacaggggctcgccgatctgccagtcggtgcgcacgtccaccgtctcgccgcccagggccacggcatagccgttctcggcgggacgcacggtgatgtcgtggtactggccgctcatcaccaccacccactcgtcgccggccttcatctcgtggccggggaactggcccgagatacgggtgtcgcgctcgtgaatgcggcggttggcggcggcggccacggcgatcagcaccgtcggatcatcggcgggcaggtcgttggcgtggaagccgttggcgtattcctcggcgatgaagttggtggtcagcgcccccttgacgaagcgttccttggagaacagcgaggccaggaaggggatgttgtggctgaggccacggatatagtactcgtccagcgcctgacgcatatgggcgatggcggcgtcgcgggtcgggccataggtgatcagcttggcgatcatgggatcgtagaacatgctgatctcgccgccctcgtagacgccggtgtcgacgcggacatgagcgctctcggccggcggctggtagcgggtcaggcgaccggtcgacggcaggaagttgcggaaggggtcctcggcatagacgcgggcttccatggaccagccgttcagcttcacgtcgtcctgggtgatggacagcttctcgcccgacgcgacgcggatcatctgctcgaccagatcgaggccggtgatcatctcggtgaccggatgctccacctgcagacgggtattcatctccaggaagtagaactcgccggtggcgccgccgacgatgaactccaccgtgccggccgacttgtagttgacgatgcgggccagggcgcaggcctgctcgcccatggccttgcgggtctcgggggtcaggaagggcgacggggcctcttcgatcaccttctggtgacggcgctggatcgagcattcacgctcgcccagatacagggtcgtgccctggccgtcggccagcacctggatctcgatgtggcggggctgctcgatgaacttttccacgaagacgcggtcgtcgccgaagctggtcttggcctcgttggtggcgctggtgaagccctcgtgggcctcggcgtcgttccaggccaggcgcatgcccttgccgccgccgccggccgaagccttcagcatgacgggatagccgatttcacgagcgatcttcaccgcctcgtcggcgtccttgatgacgccgagatagccggggaccgtgttgacaccggcttcgcgggccagcttcttggactcgatcttgtcgcccatggcgaagatggcgtgggcgtcggggccgatgaaggcgatgcccgccttgcccagggcctcctggaactcgcgcttctcggacagaaagccgtagccgggatggacggcctgggcgccggtctgcttgcaggcgtcgacgatcttgtcgatcaccagataggactgggccgaggccgccgggccgatatgcacggcctcgtcggccatggacacgtgcagcgcatccttgtcggcgtcggaatacaccgccaccgtcttgatgcccatcttcttggcggtcttgatgacccgacaggcgatttcgccgcggttggcgatcagaatcttagtgaacatgcgatcgtcccccttacagcggaatgttgccgtgcttgcgccacggattcttcacgtccttgtccttcagcatggccagcgagcggcagatgcgcttcctggtattgcgaggcatgatgacgtcgtcgatgaagccgcgatgcccggcgatgaagggattggcgaacttctggcggtattcctcggtgcgggccgcgatcttttccgcatcgccgatatcggagcggaagatgatctccaccgcgcccttgggacccatcaccgcgatctcggcggtgggccaggcgaagttgacgtcgccgcgcaggtgcttggagctcatcacgtcataggcgccgccataggccttgcgggtgatgacggtgatcttgggcaccgtgcactcggcataggcgtacagcaacttggcgccgtgcttgatgatgccgccgtattcctggctggtgccgggcaggaagccgggcacgtccacgaaggtgacgatgggaatgttgaaggcatcgcagaagcgcacgaagcgggcgcccttgatggaggacgagatgtcgagacagccggccagcaccatgggctggttggcgacgatgcccaccgtgcggccttccatgcgggcaaagccgacgatgatgttgccggcatagccgggctgcacctcgaagaaatcgccttcgtccacgaccttgaggatcagttccttcatgtcgtagggcttgttggcgttgtcgggaatcagggtgtcgaggctggtctcgatgcgctcgggcccgtcgctggtgggacgcaccggcggcttctcgcggttggaactgggcaggaagtccatgaagcggcgcagctgcagcagcgcctccacgtcgttctcgaaggccagatcggcaacgcccgacttggtggagtgggtcaccgcgccgcccagttcctcggcggtcaccgtctcgtgggtgacggtcttgaccacgtccgggccggtcacgaacatgtacgagctgtccttgaccatgaagatgtagtcggtcatggccggggagtacacggcgccgccggcgcacgggcccatgatcatggagatctggggcaccacgccggacgccatgacgttgcgctggaagacctcggcatagccggccagggaggcgacgccttcctggatgcgggcgccgcccgaatcgttgaggccgatgaccggggcgccgacctggaccgccttgtccatgatcttgcagatcttctcggcatgggcctcggacagcgagccgccgaatacggtgaagtcctggctgaacacgaagaccagacggccgttgatggtgccgtagccggtgaccacgccgtcgccggggatcatgttgtcttcggaatccatgccgaagtcggtgcagcgatgctccttgaacatgtcccattcctcgaaggaatcgggatcgaggagaagctcgatacgctcacgcgcggtgagcttgccgcgcttgtgttgggcggcgatgcgcttctcgccaccgcccatacgggcgccttccctcttttcctcgagctgctgaatgatttcgtgcatggacgcgggcctccggcgggcagagtgacattggcgtcggtcttattcgcaaagccccatggctgcaacaggagtcgccgggaaaagggcggtgttgcgaagtgattcgcaaccttcccctgcgaagttgctaaggttgcgaaggacgcgtggggcggttataaccaatggccatgaacaagaaactgttcctcggctacaaactccggcgcctgcgcgagggcaagaagctgtcccaggcggcgcttgccgtgctgctggaggtgtcgcccagctacctcaatcagatcgagaacaaccagcgcccgctgacggttccggtgctgctgcgcatcgccaaggtgctggacgtcgacctcgccaccctggtggaggacgaggaatcccgcctggtggccgatctgcgcgaggcgctgaacgatccggtgttcggctcgggctccatcgggctgtcggagctgcgcaacgccgcttcggcctcgcccgagctggccaagcgggtgctgacgctgtaccagaccttccggcagctggacgagcgcatgcagtcgctgaccgagaacctgtcctcggccacgggggaagagaggggcggacacgcccacttcccctacgaggaggtccgcgacttcttctactactgcaacaactatttcggccccctggacgaggcggccgaggcgctggtggaggaagagggcttccgcctgggccagatgcacaacgatctggtggcatatctggaaaaccgccacggcgtgcgcgtgcgcatcgtcgccgaggacgacacggcgggcatgcgcaccttcgagccgggggcaggctcgctgtcgctgtcggcgctgctgtcggtgcccagccgcaccttccagttggcccaccaggtggcgctgctggcctatcacgagcggatcgaggaggtggtggccggcgccaagctgtcgtcggacgatgcccgctccatctgccgggtcgggctggccaattacttcgccggcgccctggtgatgccctatatggccttcgccaatcaggccaaggcgctgcgccacgatatcgagcagttgcagagccgcttcggcgccagcttcgaacaggtcgcccatcgcctgtccaccctgcaacggccgggggcacgcggcgtgccgttctatttcgtccgcgtcgacatggccggcaacatcaccaagcgccactcggcgacccgcttccacttcacccgtttcggcggcgcctgcccgctgtggaacgtgcacgaagcctttgcccagccgggcaagatcctggtgcagctggcccgcatgcccgattccatctcctatatctgcgtggcgcgcaccgtgtccaagcgcggtggctcctacctccggcccgaccgccagttcgccgtcggcctgggctgcgagacggcctatgcctccgaagtggtctattccgccggcctggacctcgcctccgagcaggccgccgtgcccatcggcgtcaactgccgcatctgcgagcgcgacgattgccgccagcgcgccttcccgcccatcggcagccatatcagcgtcgacgagaacaaccggtctttcgtgccgtatctgtttgcgtgattattgataaaccaaagggaggtttggaggcatgcctccaagcgggtttgggcggcagcccaatcctcagcgccgccccttcagcaccgcgaacggtgaatccgaaggctgttccggccggaccttgcgccggggcttccggcccgtcctgaacccgtcgcccgcccgcacatagcccagcgcctccagcacgctttccgtcgccgccggtcccaggcccagggccgagtgcatgtcgtggctgggctggaagaccccgtcatgggcggcggcgcgggccagggcggcgaagcgttccaggacgtcgcggcgcaccgccaccttgcccagcacgccatagcccaccgcctcgtagaaggccggcggcacgccatcggccaagggcaccgccgggcgggggccggggatgtccggggcggaggttcccgcatggatggaccacagcagggcgcgcaagccttgcgccttgggcttgagcagggccgggatatacaggccgtgccgcccgacccggatatccaggcgggccagggccagggaatcgtccttggtcagggtgcggaccagggcctcgtcacagggcatggagcccagcccctcggccaattgatgcgccagcccccgcgccccgccggtcaacggcgcctgacccaggcgaaccagggagggcaaccggttggccagccagctccggaccacgtccgccagcctctggcgcaggcgttcgcgccccttgggcggcagcaggtcgccgtcgggggcctccaccttggggtgcagggcatcggccccggcggacaggcaggccaggggctcgccgcgccagaaaaggccgtccggccccagctcgaaggcctcgggcgggtcggccagggcctgggtcaggcggcggtccacctcgggcgccagggcccgcagggcggcggccagcatggtgcgtccggccgccgaattgtccgcctgatccacctggaagcggaacccggccagacggcccacatactcgccctccacccgcacctcgccctcgggtccgatctcggaatccatggcgccgccgtcgcgcaggcggcgcaccagcacggcggtgcgcttgtcgacgaagcggttggtgagccgctggtgcagcgcatcggacaggcggtcctcgacgccgcgggtcacctcctgccaatgggcggagtcgggcacccagtcgctgcggtgcgacacataggtccaggtgcggatgttggcgatgcgctgaacgatggtgtccagctcgccgtcggtgcggtcgatgcgccgaatgttctcggccagccaatcggtgggcaggcgacccgagggagcggccagatagcggaagatgcggcccagcagccgggtatgggattcatccatcaccttgcggaagtcggggacgcggcaaacctcccacagcagcttcacccgctcgggatggctggccagacggatgatgtcctcgtcctgggccagggcggccagggccaactggtcgtcggcgtcgcgcgcccgcagcaggccgggcttgtccggcggccggtccaggctggacagcagggcggcaacggaggcgaagcgcaggtcggcattgcgccagtagagggtcttcaggggatcgaagcggtgattctccacctgctcgacgatctccgaggcgatggtccccgcgtccatggtggtgccgaaggtgccgtcgttcatgtgccgcccggcgcggccggcgatctgggcgatctcggtgggctccagggggcgcggcgccctgccgtcgaacttgcgcagggcggcgaaggccacatggtccacgtccatgttgagccccatgccgatagcgtcggtggcgacgatgtaatccacctcccccgcctgatacattcccacctgggcgttgcgggtacgagggctcagcgcgcccagcaccaccgccgccccgccccgagaacggcggacgaattcggccatggcgtagacctcggccgccgagaaggccaccagcaccgagcgcggcggcaggcggcccagcttcttcgcccccacatgggtgagctgggaaaagcgcggccggctcatgaactcgacgccgggcaccagacggcggatcagcggccggatggtctcggcgcccaggaacagggtctcggactcgccccgggcatgcagcaggcggtcggtgaagatgtggccgcgctcgggatcggcgcaaagctggatctcgtccaccgccaggaacgccacccggcggtccagcggcatggattccaccgtgcagaccagccagcgcgcatgggacgggatgatcttctcttcgccggtgatcagcgccacgttggcggcacccttgatcttcaccatgcggtcgtagttttcccgcgccagcaggcgcagcggaaagccgatcatgccgctggcatgggccagcatgcgctccatggcgaagtgggtcttgccggtattggtggggccgaggacggcaaggatgcgggtcatgactcgaatcggccttgcaaaggactgccggttgctcttatggtccgccccgggagatcggcatggacggacccgtcgccaacccggtcaggtccggaaggaagcagccgtaacgatttccggtccgggtcgtgtccggtctcccacccttcccctacagagtcagtctgtcatcccgagcacaagcgagggatctcatcctggcatgctgtttccgaactggccaggccgcaacagacggagattcctcggctttgcctcggaatgacaagttcgggcctcggaatgaccagcagagcctcagcccgcctcgttggcgtcggcggcggcagtgacgatgatgtcgccgaactcgcgcaggaacaccgagcccttcaccgtgcgctgaatcagcaccgagcggcgatcctggtcgtcgaccttgcgcttgaccaggccaaactcggtcaggcggtccagcgcacgggtgatggcgggcttggagatgttcagcgtctccgccaggccgcgcaccgtatggggcggcggaatgaggtagacggtcagcagcagcgccatctggcgggcggacaggtcgggggcgtcacgccggacgctttcgacgatggctccgcgccagaggtcgagagcttgcaccggtttcagggaaacgcccatcatccactcattcgttgcgacgacgaaatcttttagccgaggagggactggggggcaatggctcatatggccccccgccgaattgtcataccccgggattccgaattgtcatcccgacgaccaccgggaggagggatctccgcttggccgccttttccaatgaggtagggccgtcccaggccgagattcctcgcctgcgctcggaatgacccgggggtcagggcgacagcagacgctccacctcgggcagcgcctccggggtgcccacgtggtaccagttgccgtcgtggaccagcccgaacaggcggcgggcctgggcggcccggtcataaagcacgttcagcgagaacttgccctcgggcgcgccctcgaacagccggtggtgcagcacctgcacgccggagaacagatacggcgccgacggggcctcgccccgccggtggggaacgtcggcggcgtcgaggaagaaatcgcccttgccctcgtagcccacggcgccctccactttttgcagcagcagcagggcgtccatgcggttggggtcccacatccgcgccagacgggccagggccgggaccggaccatcggtccagatgatgtcgctgttgaccacgtagaacgaggaatggccgagatggggcagggccttggccaccccgccgccggtctccagcaggtccggctcgtgggagatggtgatctcgccccggccggccagatgctcgaccaccgtgtcggccagccagtgggtgttgaccacgatatcgtcgatgccggcccgctccacatggtccagcgcccggtccagcatggtgcgcccggcgacgctgaccagcggcttgggcgtcgtcagggtgatgggccgcatcctgaggcccaggccggcggccaggaccatggcgtgggtgatggcgctcacgggctgggcactccccgcgaggccttggggatgtggcggtcgagccagcggctcagctcggccaggaccggatggcggcacgaggcctccagcagccgccacaagcggggaatgtggatcagatagccgaacttgccatcgcgcttgcacagccgggtgaagatgccgatcaccttggcgtggcgctgggccgccatcaccgcccacgaggcctcgaacaccgcccggtcgagatggggaaagcgcctgagccagcgtcccttcatgatctcgatcatcaccgggtcgatgtcgcgccgggcgtcttccagcaggctcatcaggtcataggtggccgggccgatcaccgcgtcctggaaatccagcaggccgcaggcggccagccccggacggtccagcagcagcagattgtccacgtggaaatcccgcagcaccagggtgtcgggcaccatgcgcgccaccgggaacagcctggtccagatctccacgtattcggcccgcaccgccgcgtcggtgtcgtggccgctgatggccggcatgtaccagtcggtcagcaggcaggcctcggtcagcagcttctcgtcgtcatagggcggcgttccggccagcacggaatccggccgggcggcgatctcggccagcacgtcggtggccagccggtaaagggccggctcgtcatggcccgcctccagcagccgggtataggtgccgtcgcccagatcctccagcagcagcaggccgttctcctcgtccaccgccagcagggcgggggcggataggcccatctcgcgcagatggcgggcgatgcgcacgaaggggcgcacgtcctccttgggcggcggcgcatccatcagcaccgccggcttgccgtccagcaccagccggtcgtaatggcggaagctggcatcgccggccagccgcccgcgccgggcggcgccccagccggccttggccaggaagtcttgaataagattttcgcgctcactcatgcgccaattctccgatacggtcggcccaggggccataagcggtcaaggtggcgtggcggcccagcccggcctcgccctgttgcagcagtacttcgaggcggcggcgcggcagatggggccccaacttgtcgggccattcgatcaggctgatgccctcggcgaaggcctcctcgatgtccagttccagggcgtcgtcgggcttttccagacggtagaggtcgaaatgccagaccagcccggccggggtctcgtattgctgcaccagggtgaaggtggggcttggcacctcttcctcatcgtcggtcagcgcctggatcagggcgcgggccagggtgctcttgccggtgcccagcgtgccttccagggcgatgacgtcgccgggacggaccagggcggccagcttgcggcccaggcggatggtgtcggcctcgacgggcagatcgaaggaaatgaccagactcatgccttggccctcggatgggcgtcacgatagacgcgggtgagacgcgccgcatccacctcggtatagcgctgagtggtggacagcgaggaatggcccagcaattcctgaatggtccggagatcgccgccgccggccagcagatgggtggcgaaggaatgccgcagcgcatggggcgtggcggtctcgggcaggcccatcatctgtctgaggcggcgcatctgccgctgcaccacgccgggattgagcggcccgccgcgcgcgccgagaaagatcgggtcggtgggctcggccggatagggcaggcgcttcaggtaatcggcgatggcgtcccggaccacgggcagcacggggaccacccgctgcttgttgcccttgccggtgatgaccatggtgtcgcccttgggcaggtcgcggcgggtcagcgacagggcctcgcccaggcgcagccccgcaccgtaaagcagggtgaacagcgccacgtcgcgggccgccagccagggctcgtcatgcaattcgcccgcgctggacaaggcttccagcgcctcgtcgggggccaggggcttgggaaccgatttcggcgggcgcggcgacttcaccgccttgagcgccgggttgtggaccagatcgtggcggtcgagaaacttgaagaagccgcgcagggtggacatcaggcgggccagggacgaccggcccaacccgtcctgggtgcggcgcgccaggaaggcgcggaaatcccccgcccccaggcttgccagagcggccagatcgggctcggcggccagatgctcggtcaggaaggtcaggaaggcggccaggtcgcggccatagccgtccagggtatgggacgaggcccgccgctcggatcccagccactgccaccacgattccaccgcgcgggccagatcggcctttgccgcgaaatggatgggactgggaggcatgggaaccaacgctccgggaagagtcgccccgaggcctgccccggggcgacaaggtggcgtgcctaggcggagcctgccagcggatcgtcgccgaagcgattggcaccctcggtgccgcgcttgcagaaccacaccagcatcaggatgaagccgatgatcggaaccaggaaaatcagcatccaccagcccgacttgtccacatcgtgcaggcggcggaccgataccgccagcgacggcacgaacagaccgatcagcaggacgacgggcaaaaccgacagcgcaccatcggcggccccggcgatcaccgagaagatcatgctgacgatgaaatagaacaaattgaagaaccagtattccgaccggatggcccggccctggaacgtggcgtacttactcaggttggttttgacagcggttatgaagtccatatggtccccctcgattttaacatctaccccacaaatctccgcaccgagccctcgaccacccgagccaggaaggtgatcagttcggtggcctggccggcatggaaggttcggccgtgacgcgaccccagcgccatggccccatccggtgacttccccccgggcgacagacgaaccaccgccgaggactgcaccagcccggcgccgtccccgaacagggcgggatcgcccggcatttcctcggtcagggcgcaatcgcggtcgggaccgcccatgatccccgccacggtgccgacgggaagggacaggatgccgggggctcgcaattccggcagcacctcgtccgactcctcgaagcacagcgtcgccacgtccacgtccagcagggccggcaggtcgtcggagacggcttccaccagctcggccatgttgtcggcgcccaggatggacagcacggcacgatgggtgcgggtctggatcgacatattggagcgcgaggtgtggatcaggtgctcggcggcgcctcgcacccgctccacctcgtccctgaggcggtcgatcatgaacacctgcatgtccagcacgccgtcctcgccgccccagcgcgacggcggcgacagggacagcagcaggtcgggatgtcggaccaggaagtcgggatgggcctgcagaaacgccatgacctgccgttcgtcgggcagcggcagatgcaacgcggcgtcgtcgcgcttgcgcgccatgaccaatattccttccctggttctcccttgttccgtagcttatgcacgccatgaacgacacttcaaccccctccctgctcaaccccggctccagtttgtacaaccctgggcaacgggtggccgtgatgctgcccctgccgctggggggggcctacgactacgcggtcggcgacgaggccttgcggccgggcgatttcgtcgaggtcccactgggcaaccgtctggtggcgggcgtggtctggggagcgggcgacggcagggtggacatggccaagctgcgcccggtggcgcaccggctgtcggcgcgccacctgcccgaggtgtcgcgccgcttcgtcgactgggtggccgcctacaccctggccccgcccggcgcggtgctgaagatggccatgagcgtgccctcggccctggagcccgtgccgcccatcctcgccctgcgtcttgccgccgcgccgcccgcattcaaggacaccgccgcccggcgcaaggtgatggaggcggccggacgcctgccgcccctgtccgccgccgatctggcccgcgaagccggggtcggccccgccgtggtcaagggactggtggaggcgggcgtgctggacgtggtggaattgccgccgccgcccgccttcgccccccccgacctccaagcgccccgcgccgagctgtcgccgggccagcaggacggcgccgacaccctggtcgccgccctgggaggcggcttttcggtgcagctcatcgacggcgtcaccggatcgggcaagaccgaggtctatttcgaggcggtggccgaggccctggcccggggcaagcaggttctggtgctgctgcccgagatcgccctgtcggcccagtggctggaccgctttcgccgccgcttcggggtcaggcccgccatgtggcattcggacctgggcgatgccacgcggcgcaagacctggcgggccgtggcctcgggcgaggccgccatcgtggtcggcgcccgctcgggcctgttcctgcccttccataatctcggtctgatcgtggtggacgaggaacacgatcccgccttcaagcaggaagaccatgtctgctaccacgcccgcgacatggcggtggtccgcgcccggctgggcggattcccggtggtgctggcctcggccaccccgtcgctggagagtctggccaatgtgcaggccggacgctatggcctgatccacctgcccgaccgccatgccggcgccgtgttgcccgacatcgtgccggtggatctgcgccgctatccgccgccccggggccgctggctgtcgccgcagctggtcgcggcgctggaagaggtgatggcggcgggcgagcaggccatgctctacctcaaccgccggggctatgcgccgctgaccctgtgccggacctgcggccaccggctgcaatgcccccattgcaccgcttggctggtggagcacaggtcggcgggacggctgatctgccatcattgcggccaccatatccgcctgccgcccaaatgcccggaatgcgaggccgaagccaatttcgccgcctgcggccccggcgtggaacgggtggcggaggaagccgccctgctgttccccaacgcccgcatcgcggtgatgacctcggacacctgttccggcccccatgcggcggcggagttcgtgcgccgggtctccgaccacgagatcgacctgctggtggggacccagatcgtcgccaagggctatcactttcccatgctgaccctggtgggcgtggtggacgccgatctgggcctggacggcggcgatctgcgggcgggcgagcgcacccatcaactgctgtcccaggtggcggggcgcgccggccgcgccgagcgccccggccgggtgctgctccagacctaccagcccgaccatccggtgatgcgggccctgcgctcgggcgagcgcgacgccttcatcgcccgcgaagccgaggcccgccgcgacgccggcatgccgccctatggccgcctggccgccctgatcctgtcgggggcggatgtggggatcgtcgagtcctacgcccgcaccctggccaaggccgcgccccgaaccgagggggtgcaggtgctggggccggcgcccgcccccatggccctgctgcgcggccgccatcgccgccgcttcctggtgcagagcgcccgctcggtgaatctccaggccctgctgcgcgactggctggcccgcgccgcgccacctaaaagcgtgcgagtccaggtggacgtcgatccctacagcttcatgtgaccggaattttcatgcccctcccgctgcatatcctgaagacggtcttcggctttcccgcctttcgcggccagcaggaagaagtgatccgccatgtggtggaaggcggcgacgccctggtgctgatgcccacgggggcgggcaagtcgctgtgctatcaggtcccggccttgtgccgcgacggcgtggccatcgtggtctcgccgctgatcgccctgatgcagaatcaggtggaggcgctgacccagctgggagtacgcgccgccgcgctgaattcggcccgcagcccggacgaggcgcgggtgatcgagcgccgcatgcaggccggcgagctggatctggtctatgtggcccccgagcgcctggtgctgcccggcttcctctccctgctcgaggattgccgcatcgccctgttcgccatcgacgaggcccattgcgtctcgcaatgggggcatgatttccgcccggaatacctgcagctggccctgctgcacgagcgctttcccgccgttccgcgcatcgcgctgaccgccaccgccgacggccccacccgccgagacatcgccgagcgtctgaaccttcaggacgggcggcaattcgtcgccggcttcgaccggcccaacatccgctaccgcatcgccgccaagaacaatgcgcgcgagcaattggcccgcttcatcgaggccgagcacggcgggccgggagcggactcgggcattgtctactgcctgtcgcgggccaaggtggaggagaccgccgcctggctggcgggcaagggctataccgcgctggcctaccatgccggcctcgaccagtcggtgcgcgccggcaaccaggagcgcttcctgcgcgaggacggcatcgtcatggtggcgaccatcgccttcggcatgggcatcgacaagcccgacgtgcgcttcgtcgcccatctcgacctgcccaagagcctggaggcctattaccaggaaaccggccgcgccgggcgcgacggccagcccgccgacgcctggatggcctacggcctggaggacgtggccaagctggggcagttcatcgcctccagccaggcctcggacgcccagaagcgcatcgagtggcagaagctcaacgccctactgggcctgtgcgagaccacccgctgccgccgccaggtcctgctggaatatttcggcgagaccgaccatcccccttgcggcaattgcgacacctgcctggagcccatcgcctcgttcgacggcaccgaactggcgcgcaaggccctgtcctgcgtctaccgcaccggcgagagctttggtgccggccatgtcatcgacgtgctgctgggcaaggacaatgacaaggtgcggcgtttcggccacgaacggctcagcaccttcggcatcggcaccgaactgcccgccgagcaatggcgctcggtgctgcggcaattggtggcggcgggactgctgtccatcgataccgagggccacggcgccttcaagctgaccgaggcctgccggccggtgctgcgcagcgaggtgcgggtcgacctgcggcgcgatcccctgccggccaggggcaagtccaagtcctcgggcgggaaaaagaccgcgattgcgctgagcgagccgggcgacgaggccctgttccagcatctgcgcgccgagcgcgtggccctggccaaggcccagggcgtgccgtcctatgtcatcatgcatgacgccaccctgctggaggtggcgcgccgccgcccccgccagcccggcgacctggccgacatccccggcctgggcgaagccaagcgggagcgttacggccagatcctgctggacgccgtcgccgccttcgaggcgcaggacgcgggcgaaggcaagcgccgatgaggtccgcgatggcgcccggcagatcaggaacatttagcgaacatcttgcttgcgccgctcgccgatcgcaggtaagatcgccagccatcaacacccgaattgcgcccggagcccgatcaaggctccgggcgttttcgtttgatggataccaccatgcttcctttccccctgactgaggccagcctgaaggcggccatgcgggacccgcgctacaccgagtccagccaccccgcgtccaaggcgtggcgcgacagcgttgcccagggcttcgccaccctctaccccgacgagactctgcgcggcgaccacaccgaccaactggaacggcatcagggcgccgatggccacatctacgcctcggacggaaccaaggtcgccagcgggaccgtccgtgtccgcagttacacccgcaccgtcaacggccatgtggtggaggtggcggcccacgaccggagcggcggaagcgaaggcaaggcggctgaccagggccagtccgctccgcccgccaacaagaaagcttttttcgacagcaagaacccgcccggcacctgggacgacttccggggcaaggcgcaatccctgcccaataccggcgaggccggcaaattcgccctggtggagatcttcggccaggaaggtggggtgcccaaggacagcaccagttccgcctctgccggcattcttcaggaaaccctggacaacgccaaggatgccggcgtgccgggcctggaaaagacgacaacgccggccaagctgagcaatgagcaacgcgccgccgtcatgcgctataaattggaccaggaggaattgggccatgcgggcggcatcaaggccctggaatccttcggcgatgcccagtccgccgccgccatggccgataccctctatcgccatggcggggttgatggacccaagctgctgcaaggggccatcaatgacgtgaagcctggagcggtgccgaaaaccggctacatgggcaaacagaccctggaggcctatggccggctggcgtcatcgcctgaaaccaagggcaggctgctggatgcgttggcgaagcggcgcaccactgtggccccctacgagaaggctcgcttcgactactaccgctattcggggcggcgctgatcctcaacgggacgagctattcgtagcacgtcccgttgtacagccaatgccaaccgctcggcccttcccgaccgacgaagcgccaaaggccatcatcgccgcgacgcactacatgacgaaagcggtcggatggggcagccgcaccggtcgggcaacgctctcgccggtgctgatcccgccaacattccagttcatcggtgtcgatcaccacgtcacccggccgccaagccatcgtgcaggcgtgacgataccatctgggaatgtcgttctctcccagcacccagcttgcgaccacgtggtagcgggtaattttatagagggcggacttgaatgaattttggcgatcgacatagtccaactcagcgagggcgcacaggctcttatcgctgcgcgtgtagcaggccagccagctctccaccgcgcacagcggcgaggtcagttggccgatgcatttgctgtcggtgctgtcggcatcctgggtgatgcgccaccacgtgcccggcgggtcggccggcggcaaatcctgggcagcaacgtcctctcccgccagggcgggcgccgaaacaaccaggaccatcagcagcaaccatcgtgcgagcatagcatcacgatagcacgcagccttcgccacccccagccctatcaagccaagaccccgccaccaggggtgcggggtcttgttggctaacggcctggaaagcttcaaggaaaatggcgcgcccggaaggactcgaacctccaacccccagattcgtagtctggtgctctatccaattgagctacgggcgccctggtcgtcgggaatgtcccccggcgaggacgcggaccatacacaaacaccaccagggccgcaagcgggaatttgcgtgaagcgaaaaaccgcaaaaccgtgtggactcaggccctgggaaagcaccacttatcgaaatgcgtacttgtggccgcttggtcatttgcgtaaaatccgccccaaagtttgcgggggcaatctgaacattcattcgtgaatacgaaagttcgctcccgccggtacttgtccgaactggcgacccaaaggatcagcaatccccatggccctgaaaaagacccatgccgccgccctgtgcgcggtcctcctggcgagcgggtgctcgtttgccgaggatgcgctgttcccgacctcggggactgtcgcccctaaccagggagtgagcgccgaggccgtggccgaaacgccgcccgccatgggaaccgggaattacgagcccatcggcgtcaccgccggctcgcccaccggaaccttcgtcgggggcaaggtcgttgccctgcgtggcgacctgcagtccctgcagtcgaccctggcccgccagaaccaggcgttgcagcagatccgcaacgagacggttcaggactcacagcgctatcacggcaccgtcgccgccatcaacgcccgcctccaggtgggcaccaccccgggcaatccggtgctgacccagcagtggaacgccgcccagggtgagttggaccgcatcaccgacgacgtgctgaagatgaaccgcctgaccaacgacgtgaccgcgtcgtcgaccatggccggcttcctgctggactcggtccggtcggcccgttcgctgtccggcgccgtggacgaggatcaccgccagctgcgcatcctcgaggacgagaccaaccgtaccgtggtgatggtcgagcgcctgctgtccgagctgaccagcgattccatccgtcagcagcagtatgtcgcgtccgagaagcagaacctcaacaccctggctctcggcatcaagaacggcgccctgttcgccggcggtctgagcgccaaccgcatcaacgccagctatgacgccgccccggcccgtgccatggcttcgggcgagacgccgctggtcaccatccgcttcgaccggcccaacgtgaattacgagccggccctgtatgccgccatcaagagcgcgctggatcgccgtcccagcgccaccttcgacgtggtcgccgtgtcgccggtgggcaacacccccggcacccaggccctggccgccaccaatgccaagcgcaatgccgattcggtgctgcggtcgctgaccaacatgaacctgcccgccagccgggtgcggaccacctccaccaccagcccggcggtgtcgggcggcgaagtgcaggtcttcgtgcgctaagcagggctgttcggacaagacaaaagccccgggccgctggtccggggctttttgcttggaaaggggtcatgtggactgccgcccatgcccgcgcggggccatcggccccagaccccattccattattcaacaggctgcggaaaaacgccgcttcgcggcagggctaccgccctgacccgttcagaggcgcagcctccgaacccccaggttcattttatttcagaaaattgaaataactgaagggtccgggaagctgtgctttccggttgggggatcgggggcgaaagccctcgaaggggcgtctttccgcagcctgttaaaaggtgtccgaggcatcgaccccggacgggcttgagcgagtgcccgatatcactcccgcggcatggccagggcgtcgggcagcaggccgtcgaggatcagttcctcgatcatgccctcgacgatgccgcgcgccagacgcgaggcgccggaactgcccagcatcatgttgaaatagggcagcatcaactccgtggtccgcacccactccaccgcctggccgcgcaggttgcgcttggccggcgagatagtattgatgtgggccagggccagttcctgcaaggtggtcttcagcatgccttcgagggtatttttctccagcagcagctgatattgcggattgtcgcgctcacgcgccgcccaggacgggtcggtggccggctgagccacggggtttccatccagctgctcgaccgccttggcgaccatgcgcgccgccgacagctcctcctcctcggtgcagccgttggcggtggtcatggccatcagcgcccggaggcgggccagccccctggcgcgttcgtcactattcatggcgcagccctcaagatcatcgggcaagtttatgccgggctccgcccttctgtcgatggcctaaggagcccgttgcaccccgaagtcgaggtgatcgcttgatatgcgccttcgagagtgactcggacgtcgaagacgaataaagtcgtagcgtaaaggctggggtggcaggcatgcgtaacgataggattctggaacgcaaggtcttttatgccggggcaaagatcttcaacgagggcgacagcggcgatcgcgcctacctgatccaggacggacaggtggagatcatcaagcacggcatgacgctggccaccatcggcaagggtgagctgttcggcgaaatggccctggtggacgatcagccgcgcatggccaccgccaaggcactgaccgacgtgtcgtgcatcatcatttcccgcgacaccttccgcgaaaagctggccaaggccgatccgttcattcgcggcctgctcaacatcttcgtgcgcaatatccgcaacctgacccgctgagtccgccatgcatgccctgaccggcggctggggcctggatgtgcccggccacacgcccgacgagctttacgccctggcggtggacatcgaatcctatccccgtttcctgccctggtgccagaaggcccgcatccgcagccgcgacggcgatcggctggaggtggacaacctgttcggcctgggaccgctgcaggcgcaattctcctcccaggcgacgcaggagccaccgggcaagctgaccatcacctcccaggacggcccctttcgccgtttccggctgatctggaccttcacgcccctggaggacggttgccgcgtggaggccgagtacaagatggaactgcgctcgcccatgctgcacgccatggccgccatgtccctgccggccatggagcacaaggtggcccagagcttccgcaaccgggtccgcgaggtttacgggcggtaggggccaaggatctgtcgggcgattgcccgaacccatttggggccatgccccaaacccccttttgattcatgaatgaaagggaggtttggaggtctcctccaagcggggccggggcggcagccccgcctggcttattgtcccaaggaaaaggcccggcaccttgcggtaccgggccttccctttaacggctaagccgaagagaggaggattactccttctcctgagccttgcgcatggcggcacccaggatgtcgcccagcgaggcgcccgaatcggacgaaccgtactcggccatggcctgcttctcttcctcgacctcgcgcgccttcaccgacagggtgatcttgcgcgccgccttctcgaaggcggtgatcttggcgtcgagcttctcgccgaccgcgaagcgctcggggcgctgctcggagcgttcacgcgacagctcggacttgcggatgaagccggtcatgccctcgacggtcacttccaggccgttctcggtgacctgggtcacggtgcaggtgaccacgtcgcccttcttgatggacgccacggcgtcctgataggggtcggcgcccagctgcttgatgccgaggctgatgcgctccttctcgacgtcgacgtccaggaccttggccttgaccacatcgcccttcttgaagttctggatggcctgctcgccaggagtcgcccaatccagatccgacagatgaaccatgccgtcgatatcgccgggcaggccgatgaacaggccgaactcggtgatgttcttgatctcgccttcgaccagggtgccctgggggaagcgatccaggaagccttcccacgggttgttcatggtctgcttgagacccagcgagatgcggcgcttctggggatccacgtccagcaccatgacctcgacctcctgagaggtggagacgatcttgccggggtggacgttcttcttggtccacgacatctcggagacgtgcaccagaccttcgacaccgggctccagctcgacgaacgcgccgtagtcggtgatgttggtgacgcggccggagaacttggcgttgaccgggtacttggcctcgacaccctcccacggatcggcgtcaagctgcttgatgccgagcgagatgcgctgggtttccgagttgaagcggatgacctggaccttgacggtctggccgatgtgcagcgcctcggacgggtggttgatgcgcttccaggcgatatcggtgacgtgcagcaggccgtcgacgccgcccaggtccacgaacgcaccgtaatcggtgatgttcttgaccacgccctcgaggatctggccttccttgaggttctcgatcagctcggagcgctgctcggcgcgggtctcttcgagaacggcgcgacgcgacaccacgatgttgccgcgcgagcggtccatcttgaggatctggaacggctggggggtgcccagcagcggggtgatgtcgcgcacggggcggatgtcgacctggctgcccggcaggaacgccacggcgcccgacagatcgacggtgaaaccgcccttgacgcggccgaagatcacgccggtgacgcgctgctgcgcctcgaacgacttctccagcagggtccaggcttcctcgcgcttggccttctcacggctgaggacaacctcgccgttgcggtcttcatagcgctcgacgaacacgtcgacctgatcgccggccttgatgtcggcggcgcggccggcggtggcgaattccttcagagggacgcggccctcggacttgaggcccacgtcgatcacggcgacgtcaccgtcgatctcgacgatggtaccggtgatcacggagccttcaaacgagccacccacaccgagggtctcgtccagcagggcggcgaaatcgtcgacggcctgcgcaatagcggtattggtcattgttagggaagttcctttcgtatcgtgtctttccggcctgccggttgaatccggcggtctttgcgtaaaaaaggacgtttctcaaaaaagaaaaccaccgcccagggttgcccgggcggcgtcaacaggttctgaatgctaccgtttggaaccgatgatccccagcgcggcggcaaaagcctgatcggcatcgaggtcggaggtatccagcacggcggcatcctgggccggaaccagcggggcgaccgcgcggttggtatcgcgctcgtcacgttcccgcatgtcggccaggacggtgccgtatatagcccccaggcccttttcctgcaactctttcagccgtcgctcggcccttttttccacgctggccgtgacgaacaactttacctgcgcctcgggacagaccacggtcccgatgtcgcggccgtcgagcacggcccccttgccccccggcggagtggcggcgaagcggcgctggaagtccagcaaagcggcgcgcacgccgggaatggaagccaccttggacgccgcctgggcggcttcgtcgatgcgcagatcggtggcggccaggtcatccggcgacagctgccgggccgcccgctcggccagggccacgtcggcggggtcgagcccggcgcgggccagcttcatgcccacggcgcgatagatcaggccggtgtcgagatagtcgaagcccaattcagcggccagacgccgcgccagagtccccttgccggccgccgcggggccgtcgatggcgatgatagtgctcacggattgtctccggaaatcttcgcccccagcccgttcatcagttcgacgaaggcggggaagctggtgtcgatggcttcggaatcgtccacggccacgggccgggccgaggccatgcccatcaccaggaacgacatggcgatgcggtgatcgaaatgggtggtgacggtggcgtcgccgtcggggatgcgtccggtcccgtggacgatgagggcatccttctcctcctccaccgccacgccgcaggcggccaggccgcgcgccatggcggccagacggtcgctttccttgacccgcagctcgcccaatccccgcatgcgggtggtgccctcggcgaaggcggcggccacggccaggatggggtattcgtcgatcatggacggcgctcgctcggccggcacgtccacgcccttgaggcgcgacgagcgcaccaccagatcggccaccggctcgcccgcctgatcgcggggatggtcgaagcgaatgtcggcgcccatttccagcagggtctggtacagcccggtgcgcaagggattggtgccgacgtttggcagacggatctcggagccctccaccagcagggcggccaccaccgggaaggccgccgaggagggatcggcgggcaccaccaccggccggccggtcagttccggaaagcccaccacggtaatggcgcggccaccgccctcggcgtcctcgacccgcacggtggcgccgaaattccggagcatcagttcggtgtggtcacgggtggcctcccgctcgatcaccgtggtctcgccggcggtgttgagaccggccagcatgatggccgacttcacctgggccgaggccacgggaagctcgtaggtgatgggcgtgggctgcgccgtgccggtcaccgccaggggcaggcggccgccgtcacggctgacgaagcgcgcccccatgcgcgacagcggatcgatcacccggcgcatgggccgcgagcgcaacgagccgtcgccggtgaaaaaacaggtgaagggatgggtggccaccaggcccatcagcagccgcgccccggtgccggaattgcccatgtcgagaacatcggccggctccatcagcccgccgacgccgcgcccgaacagccgccacgatccgtcgtcgcggcgctcgacctcggcgcccagcgcccgcatgcaggcggcggtgcgtaaaacatcgtcgccttccagcagaccggtgaccacgctttcacccaccgccagggcacccagcatcagggcgcggtgcgagatggacttgtcgcccggaacgggcgccgaaccggccaaaggtgcggcccgacgggatgaaagcggcttggccatgatcactcctgataaccagcggcaaggggaaaagctgcccgccgaagctctatcacaggcgccttccgcgtcatagacccgcgttccatgctgcaccgcccacgctttttcgttttgacacagggtggggaacatggcaaatggcccctttaccgggttcgagtgacacgttgaaggaggacgaaggtggcaaagccggaatggggacagaagcgcacctgccaaagctgcggatgccgtttctatgacctgacgcgcactcccatcgtttgccccaagtgcgggtcgacggtcgagcccgacatgcccttcaaggtgcgtcgcggcagtgcggcagcggcggagaaggtggcccccgtggcggcggccattcccgtggcggcgaatatcgacgtggacgatcttcccgtggccgaggacgaggacgaagtcatcgacggcgagaacgagaccgccgacgacgatgaaagcggcctgatcgaagacgcctccgatctgggcgaggacgatgacgacatggccgaggtcatggaacacatggacgaggagatcgaggacgaggtctgattcggcctcatggatttctgtttggccggcgatgaatttttcgcttgcaaggccatccgggaaaccatatgttccgcctccaccggcggggccccaagcccgcaggtaacaagtttcggggctatagctcagttgggagagcgcttgaatggcattcaagaggtcgtcggttcgattccgtctagctccaccaaaatagtgaaggcccggtcagcgatgaccgggccttctgcttttcagctacccctccttcgggactaatgctggcccctcagatagatcccgttgtggttcagccagtaagggcgcagcttcaggtcgctctggacgatatgggcggtgatccattccttggccagccccgccagttcgcgcagcaacggcgtgaaattgccgcgggcgtccagctcgtcgtactgctccttcagcagctccaccttctccaggatggcggcatgctccctgtgatgcatctcggtgaaggggaacgagcattcgcgctggattttctcctcgcggccgaaggcggtgctggtctcctcgtacagcccggtcagaaacagccccagggcggtatgaggtccatgagcccccaaggcgcgctcgaagtcgttgatgcgcccgatcacatgcttgcgggcacgatcgatctcgggttggccgatcgccatggcatcacgccaaatcagcatggcgccctccagcctctattgcggacgtatgtattttcccgcagatcagggacgaggtccagccgcgcctcgtgacgtttcgtggcgggccacaaaaaagacgttgacaatgttcctatctgacggtatataaattcccatcaacacccgaactgcgtccgacgcaagggtgtcgaccccaacccctcttcacccctctcggacaaccggacccattggtccggcccgacggacttccggcgccgttccgatggcgcccggccgctggcgcgcacggtcgggcagaaccgacggacggcgacatcccgacacaacccctcagaggaacaaaacatgtccacgagcgtcatcaacgcctactccaggcagtacggccacgaagtccatgccgcctaccagcgcatgggcaccaagctgcgcaacaccgttcggacccgcaacaacgtcaagggcgccatcgccgtcttccagaaggtcggcaagggcaccgccagcaccaaggcccgccacggcaaggttccggtgatgaatgtcgaccactcggccgtcgagtgccagctgttcgactattacgccggtgactggctggacaagctggacgagctgaagatcgagcacaacgagcgcgaagtgctgatcaatgccggcgcctatgccctgggccgcaagaccgacgaactgatcatcgccgaactggacaagtccaccaactatgcccaggacggcaccaccggcctgaccaaggccaaggtgctggaagccttcgagatgctgggcgagaccgaagtccccgatgacggcaatcgctttgccgtcgtcggctggaagcagtggtcggacctgatgtccatcaccgagttcgcccatgccgattatgtcggctcggacgaactgccgtggaagggcacccaggccaagcattggctgggcaccttgtggatgccccattcgggtctgaccaagtcgtccaacgtgcgctactgctactggtaccaccagacggcggtgggccatgcctgcggctccgaggtcaagtccgagatcacctaccagggcgatcgcgccgcctggttcgtcaacaactttatgagccagggtgcggcgctggtcgatgcgaccggcgtggtgtcgctgcgctgcctcgaatcctaagggagcttacaccatggcctatcagtccaaggacctgtcggtcctggcctatgccaacggcttcacgctgtggcactacaccaccgccgacagcggcaacaccgtcgataccagcggctatttcaacgccgcctcgaccatgctgcgcgtcggcgacatcgtcgtcgccaacgtggacaccgccgccaccatgaaggccggcctgttcctggtctccgccaataccggcggcgtggtcgacgtcaacgacctgacccagatcggcagcgccgactcgcgctagacggtctttgcccctcccccggagcgatccgggggagaccccattcgcatgctcacagctccggccctggcgctccggcgggttttccctcgcccccgccgtgtcagccgccggccgccgccccgcctccgcgcgaccctctccgcagcgggggcggggcgaggacctcgaccactccgtctcgcggggctcccgccccctgttctcggcaagtccggccccggctggaggcgatgcctccaaacctcccttcattttgaaaatgaaaagggggtttggggcatcgccccaaatgggcccgggcgatagcccgcgaacgggatcatcaagaccttaggagatccgccatggccctgtccgccatcgccctgtgttcgcgcgccctgatccgtctgggcgccgcccccattgccggcttcgacgacggctcggccgagtcggaagtggccgccaacctttatccgccgctgcgcgacggcgccctgtcgtcccacccctggagcttcgccaccggccaggtctccctggcccggctggcgggagagcccctggccgacttcgcctatgcctaccagctgcccacggattttctgcgggtgctgtcggccggccccagcggccggggctccggcctggtgttccgtattgccggctcgcggctgctctgcgatgccgacgaggtggtgctgacctatgtctaccgccccgacgaaagcgcctttccgccctatttcgaccagatgctgatggcgcggctgaccgccgagttctgtattccgctgaccgagagcaccacccgggcccagttcctgttccggctggccgaggacgagttccgccgcgccaagctgatcgacgcccagagccacacgccgtcggccatcaccgacttccccctggtggaggtgcggtcatgagcggcctacccatctttaccaagaccagcttcaccgccggcgaagtggatgtggacctggccgggcgcggcgatctggcgctctatgccaacggcgccaagtccctgcgcaacgtggtggtggcgcccatcggcggcgtccgccgccgtccgggcctgcgccatgtggccccggcccgcggccccggccgcctgatcgccttcgagttcaacaccgagcagacctatctgctggcgctgtccgaccatcggatggacatctacgccgacggcgccaaggtggccgagctggagactccgtggagcacggcccaggtcgcccagctgagctggactcagagcgccgacaccctgctggtggtccatcccgacgtggaaccccgcaagatcacccgcaccggggcgaattcctgggtcctggagacctggagttattaccaggaagacggcatcctctacgtgcccacccacaaattcgccaaggacgccgtcaccctgacccccagcggcaccagcggcaccatcacgctgaccgcgtccgaggcggtgttcgatgccgcccatgcgggctgtcgcttccgggtgggcggcaagcaggtgctgatcagcgccgtgacctcggccacccaggcccaggccgaggtcaagcagaccctgggcggcaccgccgccaccgaggattgggaggagcaatccttctcccccctgcggggctggccggtctcggtctgctttcaccaggggcgcctggccatcggcggcagccgcggcctgcccaaccgcctgtggctgtccaagtccatggacctgttcaacttcgacctgggcaccggcctggacgacgaggccatcgagtttagcctgctctccacccaggtggatgccatccgggcagtgttttccggccgccatctgcaggtcttcacctcgggagccgaatggatggtggtgggctcgccgctcacccccaccaagatccagctcaaccgccagacaagggtcggatcgccggtggatcgctcggtgccgccccgcgacgtggacggcgccacccatttcgtctcgcgcagcggccgcgacctgcgggagtttctgttcgccgacgtggatcaggcctatcaggccaacgacctgtccatggtggccaagcacgtcatgaacaccccggtggaccaggattacgatgccagccgccgcctgttccacgttgtcatggccgacgggctgatggcgaccctgaccgtctatcgcgccgagaaggtcaccgcctggacggtgttcgagacccagggggcgttccgctcggtggcggtggtggacggcgacacccatgtgctggtcgagcgcggcggcagccatgtcatcgaatgcttcgacgatacgctgaacctggacgccgccctggccggacaccgcgacacgccgacgacgatgtggagcggtctggaccacctggacggccagaccgtccgcgtgctgatggacggaacctcggtcgccgaactgacggttaccggcggccagatcacgctgccccgtccggccggcaccatcgaggccgggctggcctacgcccaccggatcgagcccctgccgccccaggcggcggccggacagcccatggccgccggcagggcggtccgcctggtccaggcctgcttccgcgtgctggacacccaggcgctgttcatcgataccgggcgcggcgccacgcccattccgttccggcgccgcggccccgagcgcttcgccacccggccaccggccttttccggagacgtcaaggtgcgcgccatcggctgggtccgcgacgtcatgcaacccctgtggcgaatcgagcaggatctgccgctgccctgcacggtgatctcggtgtccaccgagatcaagggcgccgagtagatcagaactggagaacaaatcatgaccaattacactcaggtcgccaatgtggtgccccgcgtccgctattcggccaacggcgtccagacggccttcggtttttgcttcccggtcttcgatgccgaggatctggaagtctgggtcgatcagaccctgcaaccccgcgccgcctattccgtgtccggtgtgggggtggagatcggcggcacggtgattttcaccgttccgccgcccgcctccacccaggtgaccttgcgccgccgcatggccctgaagcgcgaccgggaattcaccgacaccgccgtcgagtcctggcggctcaacaacgcgctctattaccagatggcggcgctgcagcaggtggcggacgaggcctccctggccgtcaaacggtcgttccgcagcctgtccaacgccgacctcaccctgcccgagccggcggctggccgctccatccgctggaacgacgcgggcgatgggctggtcaacagtgccgccgacgtggattccgtcctgcccctggccacctcccgggcgcaggatgccgccgccagcgccgccagccagtcgtccgccgcgtcttcggcggccagcgccaccacctcgcggaacatctgcgacgccgatgtggtggtgaccggcgccgaccgcgccgccgtggccgccgacaagaccagcgtggcggcggatcggacgacggttcacgccgatcgtctcgccgccgaggcctcggccgcccttgccctctcggccgagagcgccgccgccctgtcggcggccaatgccgccacggccgcggccaccgtctcgacccaggcggcgaccgcccaggcggcggccagtgccgcttcggccagccagtcctcggcccatgcctcggaactgagcgccgccggatcggcctcggccgccatcgccgccgcctcccaggcccaggctgctgccggaatcgtcatgttcagcaatgtggcggtttccggccaggccaccgtcgcggccgatcaggccggcgacaccctgaccctggtggcgggcagcgctctgtccatcaccaccgatgctgccagcgacagcgtgaccatcgccgtcactcaaagcggcatcgactccctgatcggcctcagcaccgccggccgcgccctgatcgacgatgcggatgccagcgcccagcggaccacgctggggctgggcaatgccgccaccctcagcaccggccatgcgagcgccaaccttcccaccgtcgccgccatgcatgccatggcggcggctttcaccgcctaaggagagatccatcatgaccgtgaccaataccgccaccttcgcccagggcatggcgctcgacgcctgcgtctgcacggcggccaagaccacctatggcgacggcaccaatgcgacgctgctgtccaccgccggcgccaacggcagcgaatacacccatatcgccgccattccccgcgccacggtgaccgccacccaggtgcagctttacgcccatgacggcgccaattacttcctgatcgccaccgccctgatgcccgcctacaccatggcccagaccaccctttgcccggccaccgccctggcccatatcgacggaacggtcatcggcgaggccaatccgctgcgtctgcaatcgggctggaagctctatgccggtatcggcgtggccctggccggcggcatcgtcgtgaccgcctcgcgcaaggactactgatcatgcggcccctcggcattctgggagcgcccatgagcggctcgcctcccgcggtgggaggctccggcggcggggccctgcagatgcaggtcatgaccgcctcgaccaccttcaccatccccgccgcccgggtgaagttcaccctggtcggcggcggcggctcgtcggccaccggtgatggcggctggaacacctcggtgggcggtggtgcgggctctggcgccaccgccatctggtacgcctcgggcctcaccgtgggaaacaccatcacggttagcgtcggcgcggggggagccacccgtaccggaacgacggttgacgggtatgacggtggcgcctcgaccctgaccagcggcacccagaccatcgccaccgtgacggcgggcggcggtcaaagggggtgggcggggaatagccctggcaatggcggcaccgcgatcggcggcaccgtcaatattgccggcatggaaggaaaccccgcctacggagggatcagcaggacctgggccggcagtgcctcgacgttgggcaagtacggcggcggcggccagggagcctatctcaccaccaacaatgtgggacagcccggcatcgtcatcgccgagtgggtcgcctgatgggagtgcacgacatgacccgaacagcaatcatcgaaaacggcatcgtcaccaacgtggtgatgcatgatcccgacggcacctggatacggccggacggcgtcgccctggtggcatccgaaacggccggggtgggcgatggctgggatggagtgtccttcacgcccatgtcgcccgccccatcgacagcgcgagccaacgacatgattctcgccgaactcggcgccatcgatgccaagagcattcgtcccttgagggccatcctggcagcccaggcagccggtgtcgcacccgatcccaccgacgtggcgtacctggccggcctcaagtcgagagccgatgccctgcggtccagcctcgccacctgatacccaattccgcccctgaagaaggggggaagcccggcccaccggtcgttccgaccggcgggccattttcatgcccgaaaggagcacttccatgacgtctcacatccgtattcccgaggtctcgccggtggcccaggccatggccgacggcgccaagagcgtcttcagctttccctttcccatcttcaaggccgccgacatcgaggttcgcgccaattccaccctgctaaccagcggctacagcgtggtcggcgaggggtccagcaccggcggcgcggtgatcttcaccgccgcgcccgccaacggcgtgcgcatcaccctgcggcgcaggcagacctatgcccgcaccgacgacttcctggacgagcgcgcccccacccctcacgagctgaacgacgcggtcgaccagaatgtcgccgccatccaggaactggccgagcaggcgtcgcgcgccgtcacccgcccgctgtccgccgacctgtcccagccgctggacctcagcctgccgaatccggaagcgggcaaggtgatcggctggaacggctcggccgacgccctggtcaatgtcgcccaggtcgatgtgtcggacgtgctgcacaagagccagaacttggccgatctggccgacaaggcccaggcgcgaatcaatctgggcttggccaccgtcgccgcctcgggctcctatgccgacctgacgggcaagccggttctgggcagcgccgccgcccatgccgataccgacttcgccaccgccgcccagggcgccaaggccgacagcgccttgcagtcctcggacatcggcgtcagcgtccaggcccatgacagcgacctcgattgggtcgccgccaacctgtccgccgccggccgcgccctgatcgacgacgccgacgcggccgcccagcgggcgaccctgggcctcgccaccgtggcgtcgtcggggacctacgccgacctgacgggcaagccggttctgggcagtgccgcctacaaggatatcggcaccagcggcgccaacgtgcctctgctcagcaccgccaacacctatggcgcaccgcagactccttccgcccaggtgctgaccgatgccgccacggtgagcatcgccatcaccgcccaagtgtggacgctctccaccgcggccgcccgcaccatcggcgcccccaccggcggcgtggccaataccttctacttcctggagatcgccagcaacggcttcaccccctcctgggcctcggccttcgacttcggcgcggccggcgcccccaccagcctcagcggcacctgcggcttcgacatcttctacgacggcgccaagtaccgcatctccacccgcttcaccggaggcgtgtaatgacccatcccaccgtcttcgggggcgcgacgccgcccccggcaaactatcggatagccaactcgatcagactcagcggaagcaattatctttcccgcacaccctcttccagtggcaatcgccaatgcttcaccgtctcgacctgggccaagcgtgtccccggaaagaggcagtggatactgtcggccgccgatgagggatatcaaggcgggctccgtctcgacgacagcgactgcgtcattgtcggtgatggccaaacggccatcggctacaacctggcgcagcagtccaagggcgtctttcgagatccctcggcttggtatcacatcgtcattgccatcgacacgacgtctcagttccaggcgatctacattaacggccaaatacaagattcggccagtggcgccattattccgagtcaggggtacaacacctcgttcaacaccgccgggcgaaccgcatatatcggcatctacaacaactccggcacgctctctttcggatacggaagctgctacctggccgattactgcctgatcgacggccaggcgctggcccccaccaatttcggcaaattcgacgccaacggcgtgtgggtgccgattccctataccggcacctacggcgccaacggctgcaagctggagttcaagaacggcagtgccctaggcaccgacacctcgggcaacggcaatcactgggcgatcaacggcctgaccgccgccgaccagatggtggacacgccgacgaacaactattgcaccatgaatccgctggactacccccccattgtcgggacgacgtatgccactctgaccgacgggaacctgacgatgacttacacgactgcctatatgggcagttcgggaaaggccgggacacgcgggacgatgcaaatgacttccgggaaatactactgggaagtcaaatgggtatcgggaagcgcctttggaggcatggccgtcggtgtcgccaacagccagtggacaggctcgaacggccttggcatgggggatgcctacagttggtcgtatgatcttcaaggatcaaaatacaccaacagcatcgcgaccgcgtttggtgcgggctgggttttgggtgatgtcatcggtgtcgcgttcgacgcctccatcggcaagatctggttctcgaggaacggggtgtggcaaggcgtttccgcccaaacggatgtcgagaacggtatcaatccggccttcttgggcctgactggcggcatgttcccggcctttgccgggcagaacaacacctcgtcgtttacgctgaacttcggccagcgccccttcgcctacacgccgcccaccggtttcaaggctctttgcaccgccaatctgccggcggtgaccatcccgcgtccggcgtcgcacttcaatgcggtcctggcctccggcgcgtcgatcaagtcctccgccgaggggctgtgcccccgcttcctcgagtggatcaaggatcgggccagcgccaacaaccatcaactcgtggacacggttcgcggcacttcggcggtgctgcaaagcaacagcaccgggactgaaaccacctattcggctccgtccggggccagtgtcgggtgggtgtggaatgccggcgccgcggcgatcgccaacaccgccggttccatcacctcccaggtgagcgccaatcccacggcggggttttccatggtgacttacacgggcaacggcgcgaccagtgcaacggtcggccatggacttgccgccgtgccaaagttctacgtcgtaaagagtcgcacgcaactggcatcttggtacgtctatagcgacgtgatcggcccgacgaaacgcctgtttctggaggacaactcggcagcatccacaggccccacgtggaacgataccaatccgacatccatggtgttttccatcagcggccctggcgtcaacaataatgcatcgacatatgtcgcctattgcttcgccgagatccccggctacagcaagttcggcagctatgtcggcaacggctctgcggacggcccgttcgtccactgcggtttcctccctcgctgggtgatgatcaaggaaaccgacaccgcgaccaactggtacatctgggacacctcaagggcgacctcaaatcccatggggaacacgttgcgggccaatcagagcaattccgacgtcaataatacgccgctcgacgccgtatccaacgggttcaagctgaggtctacacaaggccaggcggtaaacgaccccggcaatacttacatcttcgccgccttcgcggaacaccccttcggcggcgccaatgtcgcccccacccctgcacgatgaggtacatcatggattggtttcatcccgctctcggcctggtggccgcatcctccgccttcaccctggacggcgtccagtatcccgccggctggctgcgcagccagcagcccgacggcttcctgccggtgcgcgtcaccccccggcccgacgacaggctgttcttcgtctcggaacaaatcgtgaccgttatcgacggcgaagcggtggtgtcgtggaatgccgaagcgcgtgaccccgccgacatcaaggccgcccaggaccgcgaggccaatgccggcctcgtcatccggctggaggccctggacaagcgcaaggctcgtccgctgggcgccatcgtcgccgcccagttggccggtcagacgccccatcccctggacgtggcgtccctgaccgccctggaagccgaagccgccgagctgcgctcgcagattcgcggctaagcctctctccgcttgcggagagcatccgcccgccggtcctggtgaccggcgggcttttttcatgtctggagcaaagcccatgaccagccatatccgtattcccgacgtctcgcccctggtccagtcggtcgccgacggcagccgcaggatcttcgactttcccttcccggtgttccgggccgccgatctggaggtccgagtgggcgaagcggtgatcgccgacggctttgccgtgcgcggcgccggcagttccgacggcggcgccatcgtcttcgccgccgcccccgccgccggtctgcgcgtcaccatccggcgccgccagacctatgcccgcaccgacgacttcctggacgagcgcgcccccaccccgcacgagttgaacgacgcagtggaccagaacgtcgccgcccttcaggaactggccgaggatgcgtcgcgcgccgtcaggcgctcggccgccgccgacctgtcgcgcgccgtcgacctcaccctgcccgagcccgaggcggccaaggtcctgggctggaacggctaggccgatgccctggtcaatcttgcccaggtcgacgtgtcggacgtgctgcacaagagccagaatctggccgacctgcccgacaaggcgcaggcgcggaccaatctgggcctgggcagcgccgccacccatgccgataccgacttcgccaccgccgcccagggggccaaggccgacagcgccttgcaggcttcggatatcggcaccagcctccaggcccatgacagcgacctcgactgggtcgccgccaacctgtccgccgccggtcgcgccctgatcgacgacgccgacgcggccgcccagcgggcgaccctgggtctcgccgccgtggccgcctcgggctcgtacaccgacctgtccaacaagccggccctgggcagcgccgccgccctgaacgccggcaccggcgccaatcaggtggtgcagttggacgccaccggcaagctgccggcagtggacggctcggcggtcaccaacctcaacgccggcgccctggcgtcgggcaccgtccccactgcgcgcctgggcagcggtacggcggacacctcgaccttcttgcggggtgacggcacctgggcggcggtctcgggggcgaacgccgtcttgttcttttcgggggcccagacatttacgaccgcaggaacttcgatctggactgttccgaccggtgtcacctcctgctttgtcgagctttggggggcgggctcgggcggaaatggcctaaccggctccagtggctgcccctatggcggcggctatgccgcccggcatgtgaacggccttacccccgggagttcggtttcggtaaccgttggcgccgggggattaggctccggcgggactgggggggtcggcggaacttccagctttggcacgtatgtatcggcgacgggcggtgtagcccatatatcaccgggaatcggttctggcggcgaaatcaacatcgcctctcaaccgggggagatgggtactggccgtcgctccggctcggccgctcctgggggattgttctggaaaccgggctccggtggacagcactccgacaccgttaatggcactaacggcaaccagccgggcggtgctggcgggaacggctacaatacggccggcggcaatggcgccaccggcatggtcatcgtgtactggtaaatgactccccccgccgccctttccccaggcggcggggtttcttttttcccaaccgccaaggagaacgaccatggccgaggacctttccggcctccgggcccggctgtccgcgacccttcccgatcacgtggcggcggcgttggccggctacgaggatttcaccgccacctcgccgcccgccgatgccaagggcttcgccgcctggcacgcggccgccaaggcggcgctggcccatgtggacctgttggtcaagctggcccgctggtccgtgggctcggccgagcccgacggcgatgacggcttcgagaccttgctggccggtgcccgggccgccctcgacgccatcgacgaggaggaatgatgaagaccgtcaacttccccgaattcgcctggatctggaaccagcgcctgggcctcggcacgccccggcatcaggtgcgcatggcccgctggctggcggcccgctggcacggccgcgaacgggaattgctgctgatggcgtttcgctcctcgggcaagtccaccatcgtcggcctattctgtgcctgggttctggcctgcaatcccgatctgcgcatcatggtgctggccgccgatctggccctggccaagaagatggtgcgcaacgtcaagcgcatcatcgagcgccaccccctgacccagggtctgaagcccaagcgccgcgatcaatgggcggccgaccagttcaccgtcaaccgcccgggcgagttgcgcgacccctccatggtggccaagggcatcggcgccaacatcaccggctcgcgcgccgagatcgtcatctgcgacgatgtggaagtgcccaacacctgcgacaccgcgcccaagcgggccgatctgcgcgagcgtctggccgagatcgagtatgtgatggtgccgggcggcacccagctttacgtgggtacgccccattcctactacaccatctacgccgaccgtcctcgactggaggcgggggaaagccgcccctttctcgacggctttcaccgcctggagctgccgctgatcgacgccaggggacgctccgcctggcccgagcgctttcccatcgagcgcatcggcgccattcgcaagcgatccggccccaacaagttcgacagccagatgatgctgcgcccggtcaacatcgccgacggccgtctcgaccccgatcgcctgcgcctctacgaggccgagctgtcctatggcgaaggcaacggcgtgccgctgctgaccatcggggcgaagcgcatggtggcggcgtcgtgctggtgggatccggcctatggcgcgccgggcaagggcgatgcctcggtggtggcggcgctgttcaccgacgaggacggcctctactggctgcaccgggtgcgctacctggagcacgaccccgcccgcaccgagaccgacgaggccacccagctctgtcgccaggtggcgcgcttcgccgacgagctgcacctgccggcggtccagctagagaccaacgggctgggccgcttcctgcccggcctgctgcgccgcgaactgggcggagccggcatcgcctgcgccgtcatcgaggccagcagcaagcgggccaaggaccagcgcatcatcgacgccttcgatgccgtactggccgccggcgcgctgcacgtccaccgcagcgtctgggacacccccttcatcgccgaaatgcgggaatggcagcccggcgccagggggcgtgacgacggcctggatgccgtcgccgggtgccttttgtcccagccggtgcggctgtcgcggccggcatcggccaccggcggacgccccgactggcgccctggcggccgcgccgtggtcgcccattccgatttcgagttttgactcacaggagacacctcaatggaatccctcaccttcgacccccgctggtgggtcaccgccgtcgagctgcccgtgctgggcgccatggccatgatggtctggcgggttcgccacgaagccgaccaccgcatcgacgagttggagcaccggctcgacgtcggcatgggccaggcccgcgaagccctggccgcctacaagctggaagtggccaagagctatgccaccaccggctacctcaaggatgtggagcagcgcctcaccgagcatctggtccgcatcgaaggcaagctggacggcgtccagtcggccgcgcgctaggaggcggcaccatggaccccatcaccatcgccctgggccttgcccagttcgtgcccggcctgatccgctggatcggcggcgatgacgccgagaaggccgccaaggtcgccgatcaggtggtcggcgtggcccgcagcgtcactggcaggcccgacggccaggacgccctgaccgccatcaaggccgaccccgccctggcgctgcagatgcagcaggcctggctggcccacgagatcgagctggcgcgggaagagacccggcaactggccgagatcaacgccaccatgcgggtcgaagccgcctcggacgacggctatgtgcgccgctggcggcccactttcggctatgcggtggcgctgacctggaccgccaccatgggcgccatctcctgggccatcgtcgccgaaccggcccaggcgccctccatcatcgccgccttggtcaacacctcgcccatctggggcatcgcgttgggcgtcctgggcgtcgccgtggtcaagcgcagccaggacaagtcccggcggcagccatgaaaaaagggggccgcaaggccccctttcccgtcttcggcttttgccgccgtcagtccacgcactgggcgggatcggcgtcctcgctccaggtgatggagggccggggagtcttctcgatccacttgtcgagcgccaccacatgctcggcctcttccgccgcgaagtcggcgcccaggcgcttgacctcggcatcggcggaattggcggcggcgtccttgtagtactccatgccgcggatctcgttgtcgcgggcatagcgtagcgcgtggtacggcgtcatcagataatggatgtcgttctcgtcgcccacctcgggcggggtcttccagcggtactgccagctcatcagcttgggcagctccagcgcgcgggcgcgctgcttgatctcgtcgccgtgaagggtggaaaaacgcgccatgtcgcggaaaaccacggcggtctcgaggttgttgtgggcttccatcatgtcggccagctccacataccgctcggcggcctcgttttccaaagcaatggcgtgcgccagaaattctgccagggtatagcccatagtcgcctctcgtcagggaaggtggccatggcagggtatcggcgggtcggtccgtcgtcaatggcataattcggcatttaaataccgatttaaggcgcggcgccgcgtcagtgcggccggtcgcgaaccttgcgccactcggcgaacgcctcggtcatgacggcgcgcagcgccgaagccgaggccgtggggaacagatcggccagccggtcccacagcgccccgttgtggaggaagttctgggcgaaggtctccaggtcggcggcgttctcgtcgtcgaaggattgctggagatagtcgagcagccgctggcggctctgttcgtcgaagacggccatggcaccccgcacggacacgagaagcgcgtcgagccccgccaaagcggggcccgacatcggaatgcgaaacgaattccagccgttacaggctggaatccacccattcgtaaagcttgctcttgggcagcgcgccgatcttggtggcggcgacctggccgttcttgaagatcatcagggtgggaatgccgcgcacgccgtacttgccgggggtgccgggattctcgtcgatgttgatcttggcgatggtgatcttgtcggccctgtccttggagagttcctcgagcgccggggcgatctggcggcaagggccgcaccactcggcccagaaatccaccagaaccgggccgggggccttgagcacctcggcctcgaacgaggaatcggtcacaatcttcataggcaggttccttgtcgaattccaacggcggacggggaacacacgtcttcccgcccgtcaccctatcggggcgaacaccccttgggagcgatcactgtagaaagcccccgcgtcagcgtcaagcaggccgggcgtcagggtcgcgtcgcgcccggcacaaagccggcaaaaccggacaccgccacagggagacaggcccatcgatgatcggactttcgcgccgccccgccgggatgatataacccgcccgaccgctcgcggcccgcgtcccggtagctcagcaggatagagcaacggtttcctaaaccgtaggtcgggggttcgaatccctcccgggacgccaaaaacttagtaaaaacaacgatctatatattagcaaaaattacatattgcatttcacagtcatttcacattatctaacatttagtggtttgtaaaaatatctactaatagtagtatttgcgaaatggccagagccaaacgctttgaatacgtctatgccgaaagcgagccgatcgctgtgtatcagcgagctggcagtcgcttctggcaagcgcgcattacgctgacaaacggcaaatccatcgcggtcagcacccagcaagccgatccgcaaaaagcgctgcaatgggcgcacgaccacaagatcaggattgaggcgaccgaccaagaccccacggcgaagaccttcaaaaaggtagccgaggcttggttgaaggccattgaggctgaaggcagcaagtcggcagcggcctacaggaccgtcgccgagcgctaccacattccgtttttcggcacatacaagatcacgcagatcaatcagcaggtgctcgcggagtacgaacgctggcgcaaggactactggaccaaagggccaggctcaaagctgaaaaccgaaacgattgtccgcaaggacggcaaggaatacgtacgcgccaagcacctcggcagcaccgaaaaggcatatggggaagacacgacgctgcgcggcattttcaaatacgccgtcgatcacgacatgctgcccgcgtcaaaaatgcctgtcatcggcacgaaaaaatccaagtcggccaaactgatcaaggcacgacgccacccagcgttcaacaaggagcaggtggagaaaattctcgcctactgcaacacgcagccaagctctcccaaaaaaattatgcgagatggcgatttggagatggatctcaatcggccaaatctcgaccgacaggtgttcagcgccttcgtccacctcgtcctcggcactggcctgcggccagggcgcgagcatgtacagatcaagtggaaacatttccgcgccgcaaccaccgatggcgtggagcatcaaattctgaaaattgcgcctacgacaaaaacaggcgaacgcgatattcgctgcgatacgtttgcgatggcgcacctgatggcatttcggtcgctgtcaaatttcaacaaggacgacgatttcgtgatcgccgatcagctgacgggcaagcccgtgaaggacttcaaacgtcaattcaacaccatgtgcaaggcactcggcatggagactgacgtacatggcaagaagttcgtcccatacagcatgcggcacacctacgccacgctgaagctggaagcaggcgtggacatcaggttgatagcaatcattatgggcaatacgcccgaagtggcgcatgcgcattatgggcacgacagcacggtaaacagagcgaacgaactggcgaccgacttggattatctcggacttaaaaagccaaaggccaagccgaaaaagcggccaccgccaccagagccaacggcataactgtcggttttcccgacaacagcatcgcgcccaccgccgcttcggccctttgcgcgtcgtacacgccgccaatttgagcgcccagcagtacggcactcatggaaacagccccgcttgtacggggctgtttggcgtttaagcgagcttcttgccgaagcgccccttcatcgcggccaactgcttgtccagttcgccagcgaccaccgcatcgcgcaccagcgtcagcgtgggcaccagttccgccacgtcgccgatctcaatggccgtcttcttcggcttgatctccacgatcttgttgccgtagcgcacttccagcatgaacgccccattggcctgctgccaataccaggggcgaaatttgaccagtcggtcttgcagggtcttgttgccctcgccgtccttcgtccagcgcttgcgccgaatttcaaagccttcgcccttctgcatcgcttccacagcagcgatctgctgattgatggcctccaccagcttgtgccgcaagcgcccttcaggcgttgccgcgacggcacggcgggtcatttcgctcagcttcagcttgtccaatgcactcatcaccacatcctccaacaggaacacatgacgaacatactatggcctgatggccgagcaggacaaccgaaaggcaggtgtaggtttaacctacagaaggcagtgtcgtgttacacgacagccagaatgttctgcgcaacaactattctattaatggctaaagatacttagctacttaacacgcattgatatgcggctcgatgaagcttgtgcaaaaattttgccccttaaaaagggcggttttctgcgtgtttcagaaaaaatcaagaggtacggagaaaatattttccatgatttcaaaaaaaaacttgacccccagtctgaaaaaatttgttagggtacatctcatcaaatgagcactaccatctaaggggaagggaggcagaatggtcgaattcaaagctgtctccacaagcgtcgaataacacgcgcttagatagctccaaaatctcccataaaagaacatgcaccagcgcagattattctgcgttttgtgtcatgacttcgccaaaactacagaaatagtatttctgtatatcgctcaaaccttgccttttacgaggcgctgccgagaggaggacgaccatgtctatcgacaccacctgaagatgctcagccgcatacaattttggctattgcgggtacgtggcgttcgcgcttcccgtaaagccaatatcaataagaacatcgtcacggctgaattttgaccgacgagatcggcgccaagcctgaccccatataggagaaaatattatgtctcacgatatcttcactctgaccaacgcctgcaccaccctgatcgcctcccgcaagaactgggagggcgtggaactcgcggccagcaacaagcgcctctatggcattctggccgaatgctacgacctgtatacgaccgtcaccctcacgaaaacgagccgcgaactgctcactcaggttgccgacgagctcggcatccatgttgagcgcgctactccttctgcaatcaagctgatcaagattgttttcggcgcagaaccccgctggcgtgccagcaattacggccaggttctccgtattgcagaagccgaggggatcaagaccgctgagtttgtcagctggctggaaaagagcggcggcgtggaaaatgtgcggcgcggcaagacgcctgtctctcaggcgacaaaggacaagcagttcaccgatggcttggccaagctggtcggccagggggaatacgccacgcttgagcctactcgcaccatcgccagcggcagcggcctttacctgatgctttgcaccgttgaggcgaacggcgccatcaaggtccaccgccctgtcggaaatcccaacagcgatcagatcaagtccatcgttcgcgccatcggcaaggaaaacgataacgccaagagcttgacggaccccgacggcatcttcccgaaccagttctcctgctttgatgaaggtgcggttgatcgcaaggagcgcttcttcaacagcgaagaaggggaaatgagctacgaggatgcggtgaacaacctgatcggtggcggcacttctgccgacgacgccgcgagccgcgaagctgcgtaggccaatccgcgtggccaggggagtgcgcgcagcgctcccctggccttcgcaattcaatccaatttataggagaaaaatcatgtctcagtttgaactcgataacgcaattaccgacctgtccgacctccccatgccgaacggtggcgttgcggccatgtgcgacgcgctggtcaacggatggaaatctggccacatcatcatgtatgggccgaagggctcgggaaagacgacgatggcgggcctcctgccgaaggccattgcccccgacgtcaatccctgggaggtcaggctcgccaatcctgcgcaatacgacgcacggaccatcgcgcagctcgccaatacgttcatgcggacgattggcatgaactcaaagaaaaaatccttcatcatctttgatgaattcggggaaatttccaaagtcgctgtcggcactctgaataatgctctgactgactgccgcgtgaattgcatggcaattttcattaccaacaacattgacgatgttgcgccgtctatcgcaagtcggtgctacaaggccgatttcacccaagtcaattatatgaattatgtcccttatgccgagagcgtcctcaagaagtacggcgtcaccaacgtcaatcggacggcccttgagcgcgtggtgaaggccaattgctttgatctgcgcgagctcatgcgcgagcttgaagatatcgttctgaaggcacagcaaaatggggctatccctgcacctgtgcagccgcagcccttggccattgttgcaccgcctgttgcggcagcccccatcgttgcgtcaccgccctcggctccttcggccagcactattacgcctgtcgctgcggcgcaagcggtcaccaccatgaaccaatcgtcggccgcaacgccatagcacttctgtaggtttttccgacagatacacgccctcaggctcccgcctgggggctttttcttaggtgggcttggtggtgtgtaggttaaacctacagcgaaccgatgctatgctgccgagatggaaaccagcgcggccaccatcagcgtccttcaggtcacggccatcaatgctggccgcgtgctgccgttggccgatgtggaattgaccctggatggcgtggccctgatcatccacggcgttcaggttcgcgcggatgccagcaagaccgaaatcacccttcccaattacagagcgccagacggttcatggaaggccgccgtggcgctgcctgacgaaattcgggggacgatgggcgacgctgtgattgcagctctgcctgctggcaagcaaattaactatctgatgctttaattgtttggaggtgaatgctattttagtggtgcaaagctgtccgatgaaggtgctccatggatatggtcagcctaaatattgactatgaccgcccggtcaaaattgcagaaaatatctattgggttggctttgccgacagtgaaggccgcctgcaatgcaatccataccttattattgacggcgatgaggctatgctgatcgacggcggcagtcgccctgatttcagcaccgttatgcgaaaagttcttcagacgggaatatcactaagtcaaataagatatttggtttaccagcattatgacccagacctttgtgggtccatcccaaatttagaaagcatcatcaatacatctgacctaaaaataatatcacacgctgaaaacaatccatttattcgtcactatgcgccaaaatcccccctgctttgcattgataagcttggcggaaatatatcgcttcgctctggccgcgtaattcgtttttttagaacaccatacgctcattccgcaggatcatttatcacatatgatcaaaacactggcgtcttgtttacaagtgatttgtttgggagcgctggagcttttaactactggaaactttttgccactttggataatgcgtgtagctcgtgcatcataagtccaccatcgcacccggacgagccttgttctgagacggaagagccatgtccatggacaggaatgcacagttttcatcgcaggattatgccaggaaataagcaacttcaccatgcgatgggcgtgattgagacgattggagcccggataattgcccctcagcatgggtcaattctctaccgtcctgaggacatatcggcagctatagatcgcctaaagaatatggatgatattggtatcgacggaattctccctccaaagagggcgttcaaatgagctcgatgactaattttgatgagatagactggagaaatagcgcttccgccaactttgtctcacttattcttgagcaacaagcgcaattgtctgaccaaagaattaataaggagcttatgacagaattggtatcccagttcgttgcctcagagcggaaactggcagaagcgcacgcagcggtacttgccatgtcgcggactgacgccctcactggaatcgccaatcgccgctggtttgatgaatgtctggcacaagagctggcgcgcgcactgcggtcgtccactcccatcggcttacttcttatggatatcgactgttttaaactctacaacgataattatggccatgccgctggagatgaatgcttgataaaggtggcgcaagcagttcatgaagtggtgaaacgacctcctgatcttgcggccagatatggcggcgaggaattagtttgcatcctccccgataccgacgtgataggagtgcgcaaggtaggaggagcgcttttggaggcaatacgacatgcggcgattcctcatgcattttccaaagctgcaaacattgtcaccgtgagcattggtggtatttcgctcatacctgaatatggaacgacttcaaaaatgctgattgaggctgcggatgccatgctttaccaatccaaagaaaatggacgaaatcgactaacaatgtagggtcgtgcgcctttaaatgacgtccaccgcagccttcatcatatggtcgttgacctcaatgtagcgctgcgtggtggacaggtggcgatgaccagccagcgtcatgatgaccttggccgaaacgcccttgtgagccatctgcgtgatgaaccaccgccgaccgctgtggctgctcgctccatcaatgcctgccagagcatatatctgtccgaatagctggcagagcgtgttggccgagaacgccgtggccttttgcgttacgaggaacggcgcggcgcgatctgttgtcgtgttacacgacaggaagcgctcaagttcgcggcgcagcttgccgctgacgaacaccgtcctggcctcggcggttttggtgtagctggcaggcagcacaatttggtccttcacgcggccatcgccatcaatcacatcgccgagcttcaaatgggcgatctcgccgacgcgcattccagcatagaagctgagcatgagcgcaacgcggttacgcgctgcgtgacgctgattggcaacaacggacagcacgcgcttgagttccgcttcgctgagtaccttggcctgtttcatcgctttacctaatgaaaagttatcgcattgggtaaatcattatatgatcaaaagcgcggtaggcctgaccgcaattatctgcgttgataatcaagcggttaacggcaaacataatgaaatgtaagttttcttatgttttcctatgcggcggcgagcttgcttaattcgccctgcttcttcgtcaatgatgccctggtgctgcttatctgctcgcgcttcttctgcgcggaagccgcctgcttgagcttcttggcctgatcggccttggcgtcggcctgtcgtttcagattgtccgcgaagctgttggccgctgcctcctcgctgataaattcccatagtcgcatcgccgcctccctgttgacgtgtttcgcaacgctatttatgggcatgggcaagttgtcgggtttcccgacaagttggcgacgtgggcacaggccatgcgtaggttaaacctacggacacgagtgtcgtgtaacacgacaacgcgatattcctctaaatttcgtcaatatagtcaatggcttgcaaatgacgcgattgctgtcacgcagcaatgtggcgtggagtaataagccgacaaaaattatttccaaattcgcattcgcagcgccgcagatcgggataaatacaatgctggggcttaactgcatccgacgggaacagtgacagcctctttcatcagcgttttccaggccgccccagcgtttcaactgaaaacgcattgggaggaaaacgcaaatggcacaaattcaatggaacagacacatcaacaaactatgcgagcatcaaggggggccgcgatatgacgacgtactgatcggctgcatcatggcctttcaccagaaggggcgctcgtccgagaaacagggcgattggctggtcaggcagttggacatgcattacggcattcaggtggtgcatcagggcgcaatacagctgacgaaggaacagcgtcggccaatcaggcaggcagtggatttcaccaacgcccatgcatcaagtggccgcatggccaatctgaacgggcgtttccaacacgcttttcacgccgtttccacacatctcccacacagtttccacaccaaagggacaaatacgtctgcatctacaacggcttatccagtcactattgctaagctattgctaaaactaatcgatacgcctttggctgtttcgcggccttcggccacgcccaatggcctttcagccgatttcaccgatggtggctcgcttgtggctcgccactcggaagaaggaaaggcgatctgcccaatcggaatgaacgacaatgtgatcgacgatgcggctgcgccactccgtggcttcgccgcccaatcggacgagccattggggggaaagaaagagccacttggaggtgctgtggatatcgccacgtgggcgaaggccaatcggtcaacaggtcaggtgaaggccaattccagcaaggccactatatcgctttgggttgatggcagttcgcgcagctatgtgcgcggcctattggaaatagggaaggagaagtaccgcctgaatttccgcagtccacgccgcttggaggacttgatctatgtggaacgcggacaggacgcggaagcgcgggagtggtacgaggctgtcagcagccaggtcattcctaacttgcaggccaaagtggacgctgccagcggcagattgcccagcaagcacgtcgccagcgccatccacgaattccgcgacagcaaatgtgaagggcgcggcatgaccgatggcattgcattcttgggctacaacggcgacatgccatcgtattgcgtggtgcagatcaacggcaggaactggaaatttgacctccaggccacccacagtacgaacgcaagagcgccgcagttcaaggcaaccgccgagcggtcatccgaagcagcgtagcgatgatggcctgatgcacggcctcctcaatcagcacgacttcgttggcaaagccgatctcgcaatagcccctcggcaaataggtcagtctgttcatggcgttttctccttcttgcagcagcgtccagcgtggcgctgctccgcaagcgtatttaccgcggaaggctaaatagctggacgaaacgccatgaggaggaacggccatgctgttggagaaggtctatggggaattgcgcgatatgtggatggtcgagagccaatatgaattctcgcggttttggctcggccagtcgcgcagctatatgtcctgcgccaaggcgcggcagcggccaccgtcattgctggtgctgatgcggctgtcaaaccgccttgcatccatctcggccaaatatgccgctgtggcgacgaccgagatggaactggccaacgcccacaagctgcgcgagttgaatggtatggtgggcgaggcggtcgggcgacaggccgtgtaggttgaaccgaccatcagccttccagattattggcctttagatattcagcatatttaaggtcaaaatccataatgtgatcgccaagccagctcatcaagaatttagcgagatcagcatcaatggcttcagggccagaaatcatcaggcgatccatcatggactcaagcgtgaagacaagatgctcatgttcgtacatttgcttcgacaatcctggataatttgtctttgccatgctcgcctcttcgcgggcgaagtgttcttttgtgtatttggctaaagcgccaatggcgcgattaattgcatccgcgccatgagccgaagtggcaaaaatttcactcatcaaatcaaagagcttcttatggtcgctatcaatagctgcgacattaatcagcaggtcgtccgaccatgaaatttgagcggtcatcgttccctcatcctgcatttgcgatatcggtatccagttagcctataacgaaaggcttggggtatcaattggcttggcaaaatgatcggagggcaagccgtgtcggtttatccgacaggtgcatgttgtcgggtttcccgacaagttgtccgcatcgccgtcgtgttacacgacggccgaccgccgcgatcggtggtcagacttcccattatagcatacgataacgagcaaaatcggacaagaacaaagagcgaactctttggcgtgcgcactgcgtgcaaagcatggaaaatcaatgacttgcgcaacataacgatttgccaaatttcaattcacattcatttcacattgcgccacaaagctaattagtgtattgttattgtaatatattttattagcgctgtaaattcctaaaccgtaggtcaggggttcgaatcccttccgggacgccaatcttccatcgccaaaacaatgcgcaaaaagcatcctcacggtacgccgccggcgtttggcgttaacaggatgaaagtggggcaggcccgggggtccggaatgggcggagagcctgccccactgttttgagcgctgtggcgcagcattagctttcccggggcaggccagcctaggaagccgtccagccagcgggaagcggctcgccccgcaggggcatgccccccggtgccggcgcattatccgccagcaccacccggctgacccagtccaggtcgcacggatgacgaaggtcgaggccgtccggcaatgactcactggccccggaatcctgcagcatgtcgggccaggtcatggcggcttccgtccgggccaggagcagaagaagcgcccaatcgatctcacctgaggcgggggcgtcgcggttggcgggaatcgtctgcatggtcttctcctgtcagtccaggtcaaggggcagatggatactgatgctggggcgctgcggccggtagaccaccggcggcggcaggtagatcacccgggggccgccatagatcacgggcggcgggccgtactggtaggcgtaccagccgtcccggtcgcgccagccgcgatgatcggaccagccgtggtgatgtttggaccagccgggcgggccgtcgtggcgccacggcggatcagccagggcggggctggccagcgccagggtaacggcggccaccagcagtgaattgcgaagtatcgaggtgttcatgaccgcctcctgacggttctatttggacgtcgcggtctgggacgacgacttgtggccggtccagccgtcgggcagcaaggcgccgatggcggcaccaccgccggccccgatcagggcaccggtcaccaaaccgccgccggccatggcggcgatggcagcaccgccggcggcacccatggcaccgcccgacagggcccgctgctgctgattggtcatgttggcgcagcccgacagggcgacggccagaacgaccacggacatggcgggaatcttggagcggatagtcatagccttattccttcaaatctgggacgagcccatccctgataggaatacgccggcgaccggaaccggggggtgagaaggctgtgataaagctgtgactgagacgctcagtcgcccagcggcagagcgaccgagacctccaggccgccaccgggggcgccggcggcccaggccttgccgcccatggcctcggcgttgcggcgaacgatccacaggcccaggccgtaatgctcgacctggccgccctcggccttgccccgctgcgaaacatggcgctcgaagatgcgctccagctcgccttccggcacgccggggccgttgtcgcgcacccgcaacagcgccatgccgttctcctggcgcagatccatggaaatccgcccaccggggggcgagaagtcgatggcgttgtccagcaggttttcggcgatgacctccagcatctcgtcgctgccggaaatccagagcccggcggcgacgcccatgtccagaccgacggagcgctcggccgccatgcggatatagccccgccccaaccggttgagcagggccgaggcatcgacccggtcacgggggcggtcgatcagggcggcgatggtctcgtcggtacggcggatggtggagaccagcccgtccagacgctccaccgactggccgatcaggtcgagggcacgcaccgccctgacattgtcgggggccaccgcccgccccaggggctcgagggattgggagatcaccgccaacggcgccttgagggcatgggcgttctcctccgccgcctggcgcagcaagccttccgagcgcttgagggtggcgaccatggaatccagctcggcggccacctcggccagttcggggacccggttgccctcgacgaaggagaccttggcctcgccccggaccaccgagcgcgccaccccctggaagcgccgcagattgccccaggcgtcggtgaagatggacagcaccagcaccgccatcagcaggtagatggaggccgccacctgaaggtcgggggattgccagtagggacggccgatcacctgctccggcagggtgccggtgggctgggcggtcagcaccacccagcagcccaggcgggtggcatggggggccagataggtcagaagctcgccgccttcctggattccggccagtcgcagggccaggggggcgcgtccctcgcaactggcggccagatgggcaagcacgccgctctccaccagccggtccatggcgggacgggcctgttgcggcccggtctcgggagccgaggcgaccagcaggaaattgcgggcgccattggactgggccggccggaacagcaccttgatggacatgccgccctcgcccaggcgcctgaccaccggatcgatgcggtcggcgttgcgcggcgagaactgctccagcagggggaacagcgcctcgcccgccagctttccctgttcctgggccaagcgcagcatcagggcgttgcgctgggtctccaccgtctccagctgcaggtagatcaacaccggcaccacggcgaagatcagggcgatgctggccagcttgacggcgaaggatccccgccagagtccgagtctaggcatcgcgctcagcctgccagacatagccgaagccgggataattgccgatctgctcgaagtccggatcgacggtcttgaacttctcgcggatgcgcttgatggcggcccgcacattggtgcggtagccgtcctcgccggcgccgccgtgaaagcccttgccgcgcccggaatcgtaaagctcgcggtagctgacgtcgcgtccggccttggcggccagggcctcgaccatggagaactcgcccaccgtcaggtccaccggcctgccccgccactgggcccggcggctggtggtgtccaggctgagcccgccgacacgggtggcggcggcgggctcggcggcggcggcgcgccccagggtcagcgcaatgcgccgttccaggatggtgaagctgcgcgacttctcgataaaatccacggcgccgcccaacagagcggcctcctcgaagatctggtcgctgagcacggtcaggaagatcaccggcaaggcgacctgggcggagcgcaggcgacgcaacacctcgatcccgttgatccccggcatcttccagtccagtaacagcaggtcgggctccgtctgtgccgccaggtccgccagaaaagcctcgccatcgccccaggcccgcaccccatagccggcatcgcccagattgcccgccagagtctcccggaacagcggatcgtcgtcgacgatggcgatcaaaggggaattggcctcacttgccattgcggcctcccgtatcgcgcagacgcttgaagcaggtgacggcatccttgcctccctcgaattcgtaaccaagcacacgctcgatatcggtctccacctcgggatagaacaccagcgacaggacacactcgccccggcggtaacgccagaccgtgcccatggcgcgaaccgtctcgctcgtcgggctgcccagcagggcgcgggcctcatcccggctcagtccgttcaggctgtccggcgaaacggccggggaaggagcgggccgaggtgcttccgggcgagggggtgggggccggggcagaggaggctgctgggaaggaacggccggcggaggcggtgtggtggagcacgccgccagccccatgaccaggataatcgtcacgacccgccacacgaccttcaccgctcccgagattgacccgcccgcatcttattccacaccggaatactcaggtatgacttgggtcacagagtgtgtggtacaagggggaaggcgtatggttcatccccctccggccgcgctcaccgcccataggcacgcctgccctgtacaaaggtcatgccttacattacgggacgatgatactctgatcggcatccactggttcgcttcctgccctacggcgggtccgctccagggcctcggggcggggggtgccatgctcaaaatccggatacgagaacagctcatcatcagctttgccggcctgctggcggtggtggtgatcggggtgatgccgctgatgctgcgtcaggtttcggccaccatcgttcgcgcggaaacccgtgaacttgaggggttcaaccacgccttcgacgccgccgtctcggctcagtcgggcatcggcgccggcatggcctggctggtcgccggcattcccgacgtccagacggcgttcagcggcggcgaccgcgcccgaatttccgggctgttcctgccgggcttcgcctcgctgaaagccaaggtcggcgtcgatcaattccagttccacctgccgccggcgacgtcgttcctgcgtctgcacctgcccgacaagttcggcgacgacctctcgggctttcgccagaccgtggtcgaggccaaccgcaagagcagcgcggtggtcggcctggaaagcggcgttggcggactgggcgtcaggggggtcgtccccgtgctctccgatggacgggcggtcggcaccgtcgaattcggcatgtcgctgggcaagcccttcgtcgaagccttcaaggcccgctacggcgtcgacgtcaccattcacgtcaaggacgccaagaccggaaccttcaaggtgctggccgcgaccgccgatcaggcggttctcggcgaggaagactggtcccgcgccctgaccggcgccaaggtcatccgccaggccgagcgcagcgggctgccggtggcggccctggcggcgccgatccccgactattcgggcaagccggccgccgtggtcgagatcgtcatggacagccgcgactatgccgccgaatacgtcgaagcccgcaccaatgccatcatcggcgcggtgatcatcctggccctggggctgctggcggtatggctgctggcccgcggcatttccctgccgctgcagggcatcaccagggtcatgcacaccctggccgccggcgatctctcggtggaggcgccgttcacccaccgcggcgacgaggtcggcgagatggcccgggcggtcgaggtgttcaagcgcaacgccctcgacaagcggcggatggaagacgaggctcaggaactgcgccggcaggaggacctcgcccgggcggcccgcgacgaagccgccgccgaacacgctctcggcgtccaggccaaggtggcgtcggtcgacaaggccaccgacgccatccgctccaccgccaaggccatgtcccagcgatccgaacgtagcggcagcctctcgctggacatgggcgacgccgcccagatcaccagcgaacgggccaccgtcgtgtccgaggccacccgccagctggccctgtccgtggatgaaatcgcccatcaggtcagttgcgccaacgacgtgacccaaaagacggtggccagcgtggaagagacggcctcccagatggaggggctgtcgacggcggtccgcgccatcggcgacatcgtccatctgatcagcgacatcgcgtcgcaaaccaacctgctggcgctgaacgccaccatcgaggcggcccgggcgggcgaagccggcaagggtttcgccgtggtggcgggcgaggtcaagcatctggccaaccagaccgcccgggccaccgaggacatctcgcgccaggtcgaaggcatccaggattccacccagggcatggccgagcgcatcggcgaggtggtgggcctgatccgcaccttggatggtgtgtcgtcggccatcgccggcgccatacagcagcaggatgccgccacccgcgagatcgcctccaacgtcgaacaggtggcccggcaggccgacaaggtctcgggcgcggtcagccagttggcgcaggcctcggccaagacctgtgccggcaccatccgggtgatgtggagcgccaaggggctggcccagaccgtggacggcctgaccagcgagaccgaaagcttcctcggccggctgcatgggcagtagagttcttcgcacttaagctgaatctgagagtcgaggaactcttaagcccgagcggtgattgagccctgaaaaagcggcgctttttcttacagacagacacctgaagtgcttcagatgcacttcaagtcagagcgcctcagccgccgaacatttcccgggcgcgctgggcaaggccggtggccaccgagatgaactcgccgccggcgctgaggcggtcggcgccgaagcggtcggcgaaaatggcgcgcaccgccggcaccagggacgagccgccggtcaggaagacccggtccacctgggccagcccggtgccggtgctggccagcaatccgtcgacgcaggtctcgatggcggccagttccttgccgatccagccttcgaactcggcgcgggtgatgcggcgctccaccaccaccgggtcatggtcgaagcgcagcagggtctcgtcggcccgcgacaggtcgcgcttggcctgctccaccgcgcggtaaaggtgatagccgagattgtgctcgatcagcgccagcaattgctccacctgatcggggtgctccacatggcgctgcaggtcgtgcagcaggcgcagcgtcgagggcgtgttcaggaaggcgacgtggtgccagcgctccagcttggcgtacacccaggccggcatgggcaggaccttgccgtcgctaacataggtggtgcgcttgccgaaatgctcggacaggccgtgctcgaccatgcggcggtcgaaggcgtcaccggcgatgccgacaccggcggtgccgatgatggcgtcttcgggccgagccagcccggcgcgccccggccccaggcggatcaggcagaaatcgctggtgccgccgccgaaatcggccaccagcacggtctggtcctgcttcagcgtgctttcgtagtaataggcggcggcgatgggctcgtactcgaactccacctgatggatgccggccttggcgaaagcctgaagcaaccggccggtggcataggcatcctcttcctcgccgccctcggcgacaaagcgcaccgggcgtccggccaccaccttttcgaccgtggcgcccgccgcctcggcggtcgccctcagccgcgagacgatcagggccaccaactcctccagggaataggccctgccatagatggcggtgctggtgaacgaccggctggtcaggtaggacttgaaggattgcaggaaacggcaatccccgtcgccgtgcagataggcctcgatggcgtcatggccgacctggggcacaatccggcgctgggcgtcgcgccgggcattctcgaaagccagcaccgagcgcagcgtcgaggcggggccggccgtggtggcgaagtccagcacgccgacgctcccgtcggctccggccagggcgaccgcgctgttggtggtgccgaaatccattccgacgaacatgagatgaccctgtgtgagacgcctgacggggcggcggggtcgcagtcatagtgtcggcaccacgaaaacgccagaccgatttctttggtccccaccccaccccgcgacccgtcgcggggccaaacggcaaggaaagccggtggaaacctcttcttttgcatacccgctctggcccgtttgaagggttttcttcggaacgggatggatggattatccttatgggaaatgtgggtatggtgtgccgaggggcaccgggcaaggggggaaatctcatggctgaaagcaaagcggtcaccccggtcgaaggggtatcggggcgaaccgagattctggggcttggggtggcgctggccgccctggtcgccatcatcttgctgccgcttccggcgggcctgcatccggcgggattgcgcatgatggccatcatggtctttgccgtgatcatctggatgaccgaggccgtgccctacgcggtcagcgccgcggtcatcgtctcgctgatcgccctggccctgggcctgggaccggccttggccgaccccaccaagctgatggggtcctccaaggccctgggcatggccctgtccggcttttccaacaccgccttcgccctggtggccggcgccatgttcatctcggcggccatgatgatcaccgggctggacaagcgcatcgccctggtgatcctgtcgcgcctgggcgcccgcaccggccgggtgctggccggggtcatcttcaccggcttcgccctcagcttcctggtgccgtccaccaccgcccgggtgtcgtgcatggtccccatcgtcatgggcatcatcgtggccttcggggtggacaggcgctcgcgcttcgccgccgtgctgatgatcgccaccgcccaggcggattccctgtggaacgtcggcatcaagacggcggcggcgcagaacatgatcgccgtcagcttcatcgagaagcagttgcactattccgtcagctggctggaatggttcgtggcggcggcgccgttctcggcggtcatgtcggtgatcttgtacttcctgctgatgaagctgctgccgcccgaggtggatgagatcgagggcggcaaggccaccatcgccgccaagctggccgagcttggccccatgaccgcgggcgagaagaagctgctgaccatctcgctgatcctgctgtgcttctggaccaccgagaaggtgctgcacgacttcgacacctccaccaccaccatggtggccatcaccctgatgctggtgccgcgcatcggcgtcatggattggaaggacgcccaggcccgcatcggctggggcaccctgattctgttcggggtgggcatcagcctgggccaatgcctgctcgacaccggcgccgcgtcctggatggccaaatacatcgtggccaccttcggcatggagaacttcccggccatcggcatcgtcgcggtactggccctgttcctgatcgtggtgcatctgggcttcgccagcgccaccggcctggcggcggcgatgatccccatcatcatcgccgtgctgcaaagcatcaagacgccgggcatcaacatcgtgggcatgaccatgatcgcccagtacgtagtgagcttcggcttcatcctgccagtgaacgcgccccagaatatggtggtctattgcaccgagaccttccagtccaaggacttcatccggaccggcatcccgctgaccatcatcgcctacatcatgatcctggtcatgagcgccacctactggcgctggctgggcctgacgggatagaaacgactcggggccgccttccttgcggaaagcggccccgagccggttcgttcccttggagaagagggaacctgtaaacgcgtcagccgtccacccggacgatcacctcgacccggctgatgttcagcccctcgggcgcgctgggcaccttggagacggcgatcagatcgccggggatgtcgcacagcttgccgctcttctcatagaagaagtggtggtggtcgctggtattggtgtcgaaataggaccggccggcatccaccacgatctcgcgcagcaggcccacatcggtgaactggtgcagcgtgttgtagacggtggccagcgagacccggatgctcgacgacagcgcctcggtgtgcagctgctcggccgagatgtggcggtcaccgctatcgaacagcaggcgggccagggcaagacgctgacgggtcgggcgcagccccacggcgcgaagccggtccaaggcgtggctgtaggggcgaacggtaatcatggtcatggtggcatccgccctttcggggtggggtggcgtcgattgatctatctcagaggccgtccggaaggttcttgaatcaggtgaatcggttatgattccatgggtctccagagaaatgctgggggcgccatgtggaccaaggacaaccgacggctctatgagcggagcggacttcgctatccaagtgatctgacggatgaggaatggtcgctggtggcgccgctgatcccaccggcaaagcgcggcgggcgccagcgaacggtggatcttcgtgaagtggtgaatgggatcttctacgtgttgatgaccggttgccagtggcgagcattgcccacggacctgccgcccaaaagcacggtgcatgaatatcttgggctgtgggaatgggatggcacgctggcacgcctccatcacgccctgttcatcgaggtgcgggaactctccggcaaagaagccagcccgacggcggcgatcatagacagccagagcgtcaagggcgcggaaaaaggggggcgcggattgatccatcgggctacgacgctgggaagaaggtcaaaggcaagaagcggcacatcgtcgtcgatacgcttggcttgatcctcgcggctcatgtccaaccggccgatgtccaggatcgtgatggcggattgccggtcctcaaggaggtccggcgcctcttccccttcatcgttcgggtgttcgctgatggcggctaccagggggccgccaccgcggcagccgtccgcgcactcggggcgtggcacctggaaatcgtcaaacgctccgacaccgccaaggggttcgaagttctgccaaagcggtggatcgttgagcgcaccttcgggtggctggggcgttgtcgccgtctcgccaaggacttcgagaatctcgccaggatggcgctggcgtttcttcgcctcgccatgatccgcctcatgctgcgaaggatagcaagacaccggaaatcataggaaacttcacggacggactctcaacgctagcatggagttcttcgaaaaacaaagtccttaacgccaatttttgtggcagttagggctttggtattaatgagttagtcgtaacagccatttttcatacatggttacgcgcccgggcgatttccataggttgcctcacgtccggccgctcaggcccgctcgggagcctcccaggggaagaccagccaggttttctgacccacgtcctccacatgggtgtggaccaggggccggcccgagggcttggcgtagagggtggcgtaatggccgcccggcagcatgtcgcggatggcctgggcggtgcgcccggtatccaccagatcgtccaccaccagccagccggtgccgtcgcccggaacccgcttgaggatttccaggtcatggcgcgtgctttcatcatagccggcgatgcacacggtatccacctgccgaattcccaactcggtggccaggatggcggcggggaccagcccgccgcgggccacggcgatgattccggtgaacggccccttgtccctgagcttgcgggccagccggcgcgacaccgaatggatctcttcccacgacagggaacaggcatgagaaaaggcgggatcgagggtcatggcggtccggttgcataatgagcggtatcgccactctggacggcgggcggcaatttcgcaacaatcgcccagccaccgataggaacagccgcccgatgctcaattctcccatggcccgccggggcatggtcacctcgccccaccacctcgcctcccaggcggggcttgccgtgttgcgcgaaggcggcaccgccatcgaggcggccatcgccaccgccgcgaccctgggcgtggtgtatccccacatgaccggcctgggcggcgatgccttctggctgatcgccgagccgggcaagccgccggtctccatcgacggctcgggcgccgccggggccaaggtggacctcgacctctatcgcaaggccgggcacaagcgcattcccacccgggggccgctggccgccaacaccgtggccggcgccgtctccagctggcaactggcgctggacgtctcgggccattggggtggccggctgccgctgcgccgcctgttcgaggacgcggtcttcgcggcgcgggaagggtttgccgtgtcgcgccatcaggccgccgccacccagcgcgggctggccgacctgaagcgccagccgggcttcgccgagaccttcctggccaagcgcaaggcccccgctccgggttcggtgctgcgcctgccggccctggccgacacgctggaacggctggccaatgccgggctggacgatttctatcgcggcgaggtggcccgcgccgtggccgccgggctgcaggcggcggggtcgccgctgcgggccgaggatctggcccgccatcgcggcatgcgccgccggcccctatccctcaacctgccctgcggccacctgttcaacaccgcgccgccgacccagggtctggcctcgctggtcctgctgggactttaccagcggctgggggtgaccgaggccgacggcttcgaccatatccacgggctggtggaggcggccaagctggcctatcgcgtgcgcgacgcccatgtcaccgatcccgcccgcatgtccatccacgccaccacctatctcgaggacggcgtcctcgaccgcatggcctgggagatcgacaaggccaaggccagcccgctgcccggcgccggggccgagggcgacaccgtctggctgggcgtcatcgacggccagggccgcgccgtcagcttcatccagagcctgttccatgcctatggctcgggcgtcgtgctgcccgaggtggggctggtgtggcagaaccggggctgctcgttcagcctggaccccctgcaccgcaactccctggagccccggcggcggcccttccacaccctgtcgcccggtctggcgcgcctcaaggacggccgcaccatggtctacggtaccatgggcggcgacgcccagcccatggtccaggccgaggtcttcacccgggtggcgctctatggccaggggctgcagccggcggtgtcggcgccgcgctggtgcctggcccgcggcctggacggcgcccccgctccggcgggcattcaactggaaagccgtttcgccccccaggtgatccaacgcctggaacaggcggggcatcagctccaggtggtgggcgagtgggactcgctgctgggccatgccggggcgctgctgcgccgtgccgacggcatcatcgaaggagccgccgacccccgcgccgatggcgtggtggcggcattttgacgagaggataggagcatatgggtaccattgtgctgaaacacgttcccgaggaccgcgtcaacggccgcgagatcgtcgataccggtgttctcatgatgggcctggagggagacaatgttcattgcggcgtctgcggccgtgagatgatgcacgacgttcccatccggaccatgaaggtcaatctggtctaccgctgtgccggctgcgattcgctcaacgagctgccgccggacgcttaggagtagaacccatgaagctctattacaaggtcggcgcctgctcgctggcctcgcacatcgccctggaagaagccggcattccctatgccgtggaggccgtcgacctggtggccaagaccacggaatccggcggcgacttcctggccatcaatcccaagggctatatcccggccctggtcatcgacgacggcatcgtcctgaccgagggcgtggccatcctgctgcgcatcgccgccatggcgccggaaaagggcctgtcgcccgccgtgggcacccaggattacatgaagctggtggaatggctggtgttcatcgccaccgaactgcacaagccggccggcatccagttcaacccggccatgcccgaggaaggcaaggtggcgctgcgcaccgtcctgagccgtcgcctggattacctggacaaggccctgggcaaggggccgttcctcatgggcgagcggatcacggtggcggatttctacctgttcacagtgttctcgtggctgccgcgcctgaagatcgacaccacgccctggccccatgtggccgcccttttcgagcgcatccgcacccgccccgccgtgcaggcggtgcttaaggccgaggggctggcttaacaggcggcggaggaacaccccttcgggggcttttgcccccgatcccccaaccgggaagcacagtgtcccggacccttcagttttttaaagcctggagggttggaggctgtgtctccgaacgggccagggtgggtgccctgccgcgaagcgggcttggtcaaaatcccgccagggaccgcacctcgtccggggtgcggcccgcctcgcgcagggccctcagcgtcagcgagcggtcacgcttggcataacgccgcccgctcgggtcggtgagcaggcggtgatggaggtagcccggcaccggcaggcccagcagcgcctgcaacagccggtgcacatgggtggcctcgaacaggtcctggcctcgggtcaccagcgtgaccccctgcagggcgtcgtcgacggttaccgccagatggtagctggccggaatgtccttgcgggccagcaccacgtcgccgaacagttcaggctgggcggtctgctctccctgcgcccggtcatgccaggccaggggaccgacccgcgccgccgccgccgccacgtccaggcgcaacgcaaaggcctggcccgcctcgcgccgctctcgccgttcggccaccgacagatggcggcaatggccgggataaagcggcccatcggggccgtgcggcgcatggccggcaccctcgacctcgcgggcgatatccttgcgggtgcaaaagcagggatagagcagccccatgccctccagccggtccagcgcggcgcggtattcgtcgaaatgctccgactggacgcgcacgggccgttcccagtccagccccagccagccgagatcggtgaagatcccttgagtgaactcggggcgacagcgggtgcggtcgatgtcctcgatgcgcaaaagaaagcgcccccccgccgcctttgccgcggcaaaggcgaacagggcggaatgggcgtggcccagatgcagttccccggtgggactgggggcgaagcgggtgatggtcacaatatgtcgcgagctttggcgggacaggggcggcgaaccataccataatgcctccagatcgtatcgtcaggagccatcatgcccagtccgtcccccatcacactgtccggcccctcggtggagcccgcctcgggcggtcccgccgcccagttggtggtgctgctgcatggggtgggcgtcgacggctcggacctgatcgagctggcgccgttcttcgcctccatcctgcccgatgcggccttcgtggcgcccgatgcccccttcgccttcgacatggctcccttcggccggcaatggttcagcctgcaggaccgcagcattcccgccatctcggccggagttcgggccaccgctcctatcctcgaggcctatatcgacgagcaggtcgccctgtggggggtgcagcccgccgacgtggcgctgatcggattcagccagggaaccatgatggcgctgcacgtggcgctgcgccgccccgtcgccccggcggcggtggtgggcttctccggcgccttggtcgatcccgacgagttgccgaaggagatcacggcgcggccccggaccctgctgatccacggtgccgacgatgaagtggtcaaccccaactgcctgaaggccgccgagcaggccctggccgccgtgggcgtgccggtgctgaccgaattgcggcccggcctcggccacggcatcgacggccccggcgcccagatggcgctgggcttcctcggccaagtgttcggcgtcgaggcctgatcccagccgggcttcaccgaatcatcacgaaaaggggtatggaacaccaatagcgaatactatattttgtgaacgtctctcgttggaagggagaagggtttggtcgcgttcgactgccatcctgccctgtcgccgaccgccgcttcgcggccgttcagcgaaaccttccctgcgccccgggcaggccacccgcgaggtgcggcgtgacccatctcggcctcccccagttgaagaccctggttctcaatgccgacatgcagcccctgagctggggaccgctgtcggtgtggccgtggcaggatgccctggtggccgtcctcaaggatcgcgttcaccaggtctgcgcctacgacctggaggtcagatcggccagccgctcgttccggattccatccgtggtggcgctcaaggattttcaccgccgcaagagcgtgtcgttcacccgttaccacgtctttttgcgcgatggcttccgctgccagtactgcgccagggtgttcgacacccgcgacctgaccttcgaccacgtggtgccccgttccaggggcggcaagaccacctgggacaacatcgtcacctgctgcgccgccgacaacctcaggaagggcgccaaatccctgcgcgaggccggcatgcatctgctgcgacggcccttcacgccgacgccctaccagatggacgtggcggcccggcactgcgcccacgtgaaggacgacctgcacgagacctggatggatttcctctactgggatgtggccctcgaggaatagagggttcagggtaccgcgaattgccagccgaaccagcgccagcggccttccagggccggcacggtgcagttcagccgcccccgccccgagggaatgggcttggacatgcgcacttcgacccgcggccccaggcgttcaaccctgacctgcccctgatgggaggcgaagcacgacagcccgtcgatgccgggcacgtcctcggccagggtgaagccgaaggccggcggattgaccttgatggccggatcctccggcgtgatatccacggccggcaggggcagggagcgggccgccagccggaagcgctgcatgtcgccataggccgagctttgggcgaagcgcggcaggaagaacggatcgcccttggcccaggcggcaccggaatgctggccgaaggcggcggcaaagcccgaacggcgcagcacgtcttcggcctcggcgctggcctcgccccagggccaggcgaacagttcggtgcccaggcccagttccttgtccaggcgggccctggcgcgggccagatcggcggtgatctgctcggccgaagccttgggcaggcgcagccgggcggcgccctgcatgccgatccccaacccggcggcggccagttcgcggatctgcccccagctcatcacctcggcgccgccacgatccacctcgtcggtggccaggaacagggtgacgggcagccccgccttcttcagcagcggccatgctccggcatagaaccccaccgaggcgtcgtcgacggtaatggccaccgccttgtccggcagcgaccgaccggcccgcagcgccgagacgatctcggccagcggcagcacggcatagccgccggtcttcaactccgccacatgggaggccagcagctcggtggtggtgttgagcgccggcacccggtcgtcatcgaagcgatgatagaccagcaccacggcggactcggcggccaaggcggcggaaccgcaaaccggcagccccacgaccgcggccagacacaccagcagcgccaagacaacagactgtttcacaatcgccccctgttgggcgccgctctcggcgcctacattcccgatgtttgccgcattcgcgggtgaaagttcaagaggagaggcggatatgagcgatattctcgaccccacggcgctggacaggctgttccgccaggcccgcacacattccaaattcaaggaaacccccgtgcccgacgccttgctgcgccaggcctgggacctggcccgcatggggccgaccagcgtcaattgccagcccatgcgcgtggtcttcgtgcgctcggccgaggccaagcagcgcctcaaacccgccctggcgcccggcaacctggacaagaccatggcggcgccggttaccgccatcatcgcccacgacatggagttctacgagaagctgcccaagctgttcccccacaccgacgcgcgcgcctggttcgtgggcaacgaggccatgatccagtccacggccttccgcaacggcacgctgcagggcggctacttcatcctggcgctgcgcgccgtcggcctggatagcggcgccatgagcggcttcgacaatgccaaggtggacgaggccttcttcgccggcaccagcctgcggtccaatttcctgatcaatatcggctatgacgacgaatccgggctgttcccacgtggtccccgcctggagttcgacgaggcctgccgggtggagtagaccggggctttcagccccgcaccccgatcgggaggcatgcctcccgaaccctccccttattttcaaaatcaaaggaggttcggagggttccctccgagcgggtccgggcggcagcccggcgatcactcagccgccgaataccttcttcagcaggtcggtggagcggctggccgggttggtgcggatggacgcctcttcctggccgagatagctgaagatgcccgacagggcataatccagcacatggtcggtcagcatggaggggccggccttcagggcgtcgcccaccatgggcaggccctgggcggcgccggccatgctggtataggactgcaccgcgcccgattgcgagacggtgttgtccaccaccggccgcatggcggtgcgcaggtcgggactcatggtccgcttgaaatactgggtggcggcatccttggggccgttcaggatgccccgcgcatcgtccagggtcatcttctgcaccgcgtcccagaatatctgcttggccttaggggtggcagcctcggcggcgcggttgagcttcagctccaggtcgtcggccatctgcgacttgccgaccagggccagcccctgctttaccttggccagcttgtcgggcagagggatatgcacgctggaatcggcgttgaagccgtcggtgcggcccagctggccggtgaccttgtcggcggcgacccgcagggcctccttaaggcccgagccgatttccgaggtagacagggacgagcccgcgccggacgacgacgagccgccggcccgctgctccagttcctgcttgatcatccccttgcccaggtccatcaggctgccctgagccagaaccggcgagacgcacaacagcacggccgcggcacccaggcaggcggtcttgacgaacaggctcattgtcaggcctccaggatgtgcagtatggcgccgtcggcgccgaagcaggcggcggtcagggtgccgccatgacccgaaccggaatccagggtggcggcgaaggggccgagcaccttgccaccgtggcgccggtcggcgccgcgcaccaccagcttgaagccggaatagggctcgtccatgccggcgaacaggctggagccccaccagaaggcatccacctgggcagaaagcggccgcgtggggtccagaccggcatgggtgaacagcagcgtattgtcgtcggtgaaggcggcgtgcttcagcacgctcatcagcgtggtgtggccgtcgtaattacgcatggtctggcgcagctggctggtccagcgggtcagggccaggatgccttcgcggatggcgttctgcccctcctccaccgatccgccataggcggcgatggtcggcgcgatgccgtgatcgaccatccagcgcaggacctcggccggattgggggcgaactgcaattgcagcagcttctgccacatctcttcctgggtgccgcgcagatagaccacgtcctccacttccacgccgggcgtggcgatgaaggagcggcggaaggtcagcaattcgtcgatggtctgcagcaccggagcgccacatcccaggtaatcgccgagatagaccaactggtcgccgggccgcaattcccgggacagccgggcatgcagggcgcacaggcgggcatgctcgccccggacggcggcgacggcccagactcgaccgccgccccgcagagtcgcgaagacgttggaatcagcctgggtcgtggacgttcgttcggcttcgacgatcatcaatccgctcgggttcgccaaccgggtgtcatggtcgcagccgccggcccaaacatcaagccgcttcgagcaggccctgcagcttctcggtcgccgcctgggtgtcgatccgctccaccgccgccaattccgaggccagacgctccagcgcggcctcgtagatctgacgctcggaataggactggtcgggctgattggcgttgcggtgcaggtcgcggaccacctcggcgatggaaacgggatcgccggaattgatcttggcctcgtattcctgggcgcgacggctccacatggtgcgcttgaccttggcgcggcccttgagggtcgacagcgcggtgtccatgaccgagcgggacgacagcatgcgcagccccgacttctgggccttggtcaccggtacgcgcagcgtcatccggtcgcgatcgaaggtgatgacgaacagttgcagcttcatgccgccgatttcctgggtttcaacggccaccacctgacccacgccgtgggtgggatagaccacatagtcgccctgggtgaaagaaacgatcgtcatcttcaacaattccctcgacagaaggtccggatccggcaaaagcgcccgatacgcccaacgcaacaaacgaaagatgctcgccagccgcgcccttgacgggctggttcaaatctcgcagcttgtcttggtgggcgaactcccgccccgatggctttgccaataagctgtccgtcggcacagttcgacggacttgcccttatagcacaggcgccttctgtgaagaacaggaaaattccccaaaggcctgcgtttccgccacgtctccatgcgcaaacgccgccccacgaccctctgggtcctgggccggcgccggctacaatatcttgcggaaaggatcagcggcccggattgggcgacagcagcttggccttgtcgggcttgcccttccagtcgtcggcatcggcaggagcgtcacccttgcgggtgatgttgggccacgagccggcatactggcgattggtgtcggtccaggcggtagccttgggatcggaatccgggaagatggcttcggccgggcattccggctcgcagacgccgcaatcgatgcattcgtcggggttgatcaccaggaagttctcgccctcgtagaagcagtccaccgggcagacttcgacgcaatcctggtacttacacttgatgcagttctcggtgacgacgtaagccatgtcgttctccaatatcctttgaaatcgtgatgcggcgggcaaggcttgcctccgccggaagaaaatccggcggaagcgatagcacagtcaccccccggggctcaaccccagcggcgggagggacatccccgccctacggcacgggggtgcgcagcttgaccggcgcccgcttgccgcgccgggccagcagattgaggatttcaatccccagcgagaaggccatggcgaagtagatgtagcccttgggcatgtggaagccggtcccgtcggccaccagggtggccccgatcagcagcaggaacgacagtgccagcatcttgatggtggggtggcgcgcaatcagcgcggacaggggattggcggccaccaccatcacggccgaggccaggatgacggcggccaccatgacgcccaggtcgcgggccatgcccacggcggtgatcaccgaatccagcgagaagacgatgtctagcacggcgatctgcaccaccaccgaggccagaccggcctcgaccgccttgccggcggccccgtcctcgccgacggcccccgccgtctcctcctcgccttccaggctgccgtgaatctcgtgggtggccttggccaccaggaacgtgccgccaccgatcaggatgatgtcgcgccagctgaccgggtggtcccagaccacgaagaccggctcgaccagcccgacgatccagctgagcgacgccagcaggccgaggcgggtgacgaccgcgaaggccagacccagccgccggcccaggggacgcaggcgctcgggcagccggttggaaatgatggccagatagaccagattgtcgatccccagcacgatttcgagcaacgccaaggtcgccaggctgatccatatctcgggatcagagatccaggccatcgtcatgctcatgattgtcctcgagacgggttcggttcacggaatgtaagggattcagcctaagaatccacgcagaactcccttaattctccgtaacgtcggtgaatacatttggttttgaccgcagccaaatcgcccgataccattgaaagagtggacgacttccattattcccggccacagccgggaaaggaatcacgggtgaagagcagcacgaattcgggcaacgaacagggggcgtccgccactcaagcctccgccgggcttgccggaggagctccttgcgcccccagcgaggcattgccgcgtctcgtcgaggctgaggcgcgcctggacgggctgaccgccaaccttcccggttttgcctttcagcgcagcctcggtaccgatggaaccatccattacccctggttcagccccagcatccgatccgtcctgggctttgccgtagagtccatgggcgtcaattcccaaggatgcctgcacgcggtgcattgggccgaccgagacacccacttggccgaaattcgccgctcggcggcccaaatggacacctgccgcgaggagttccgtgccatcagcgcccatggcgaggtccgctggctaaagggcgcctcggaaccccgacgccaggaggacggctcggtcatctgggacggggtgatggtcgacgtcaccgacggccgccgcgccgaacttcgcctggaaatgctgatggaccatgccggcgattccctgatcgtcgtggggtcggatggcactatcgacagcgtcaatgccgccgccgaggccctgttcggctgggcgtcgagcgaactggtgggcaagccgttcaccaccttgctgccgcaatcgctgcacctggacgacctgctggaatccgccgaggtttcggccgggggcatcgtcggcggcggtgcgcgcgaactgatgggactgcgcaaggacggatccaccttcccgctggaactgtccaccaccgaggtccggctggaggggcagcggctgttcatcggcatcggccgcgacatcaccgagcgcaagctgaccgaggcggccttgcgggaatcggaagaacgactgcgcgccatcgccgccaatgttcccggcatggtgttccagcgcgaactgcaccccgacggcagcctgtgcttctcctatgtgagcgagggctgccgcgccatcctgggactgggccccgagcaactgatcgacaatcctcagttgttcctgtccctgattcccgaggacgaacgctccggcttctatgccggtctgggccgttcggcgcggagcatggagcccttcgacgaggaaatggccgtccccggaagcgatggccgccgccgctggctgcgcgggcagtcgcgccccacgctgcgcggcgacggcaacgtggtgtgggacggggtcatgctcgacgtcaccgacagcaagcacgcggaacagcgcctgtccttcctggcctatttcgatccgctgacccggctgcccaatcgcaccgccttcctggaacgctttgccgccgcccgcgaaatcgccgcccgcgaccagaccatgcttgccgtggtcagcgtcggactcgaccgcctgggcatcatcaatgccaccatgggtcacagcatcggcgatcaggtgctgatggcggcgggagacctgctgcgcgccgccctgtcgtccaatgacgtcattgcccgtacgtcgggcgaccggttcctggtgctgatcaccgggctgggctccaagcgcgaggccatggaggccctggagcgtctgcgggcctcggcccacgccaccgtggcggcggcgggacaggatttcgacgtctcggccgccatgggtgccgcggtttatccccgcgacggcgacgacgccgagaccctgatcaagaacgccgacgccgccttgcaattggccaaggtgcagggacccgccaccttgcaggtcttcaccaaggagatcagcgccagggcggcaaagaccctgtcgctgcagacccggctgcgccgcgccatcgaccagggcgagctgatcgcccattaccagccccaggtcgacctgcgaaacggcgacgtggtaggcatggaggcgctggtccgctggaacagccccgacttagggatggtctcgcccgccgatttcatccccgtggccgaggaatcgggcctgatcgacggcgtctgcgagttcatgctgtgggagtgcacccgccagaacaagcagtggcaggacgagggattgccgcccatccccgtggccgtcaacgtctcgggtcggcagttccagtatgcgcgccgcctgctgtcggcctgcgaacgtgccctggtggacaaccggctggatagccgctggctcgaggtggaactgaccgaaagctcggccatgcgtgacgccgacaatgccatcgccgtggtcaatcagttgaaggagatgggcatcgcctgctccatcgacgatttcggcaccggctattcctcgctgtcggtgctcaagcgctttcccatcagcaagctgaagatcgaccgctccttcgtgctcgacgtcaccaccgatcccaacgacgcagccatcgtcgacgccatcatcgccatggccaaggcgctgcggctcaaggtggtggccgaaggcgtcgagcaccaggaacacctggacttcctgcgcaacctgggatgcgaccagatgcagggctatttcttcagccgccccctgcccgccgatggcatgcgcgccctgctggccgagggtcggcggctgcacatgaccgaggcgacccttcacagcgtcaccgcctaaaacgccgcattttcatccacgttctcgccgcaagttcattcttcctatcaacggccaacattggcagttgacggattcgagcatttccgcctattcatttcgggtgggtgagggcatctgatacggcaatcgaatccgggccatgaaagatcatacagcgaccgccgcgaccgccacggtgaagcattcctataccatcccctgcgccagcgccttccgcgacgcggtggacaagctcgccttgcggcggcgggtcaatgtgggcgacatcgcccgctcggtactgctggtggtcccgcccgagactatcgccgccttccccgaccccggcgagcccgagcccgaggaccgcgagaccgtcatcctcaaatccggcccggccgaggggcgtccctggcgccgcaagccgcggctgcaggtgcgcatggcgcccggctacagtgtcgaggccatccgccgggcattggccatggccctggccatggcccagggcgatgtccgcctccgggtcgagcgaccgggggaagaggtcgccccgcctcccccacccccgcctcccccctctccgccgccgccggcccaggccgatcccgccttccccaaggaggagcgccgccggggcgtacgcgaacaggccgtggccatcgcctccgccaacgaggaaatcgagcgtctgcgcgccatcatcaacgtactgtccttcgagccgctgcccaacggggtgatgacccgggcggacgccctccatatcctgggctttccgcctggcgccgcccccgatcgccgcacggtgcgggccaagttccgcatgctggccaccatccaccatccggacagcaatcacggcaaccaccaccgcatgagccagctcaaccaggccatggaagtgctggcggaataatcccctttccggtcgggccgccccttcccatatgacctggatcaacccaggcgggggaggccgatcatggctgtcaccggtaccgttccaccccaggccgcgccgcttcgccgcgagcgggtcagagccgtcagcgtcccccaggtcctgggatggatcggcgccggctggcgcgacacccggcgcgccgcgcccttcagcctgttctacggcgccgccttcgtgctggcgggctttgccgtcaccggcggcctggccctggcgggactggaatatctgatcacccccctggtggaaggattcatgctggtggcgccgctgctggcgctgggtctttacgaggtttcccgccggctggaacggggcgagcccctggactggcgccccatcctgacctgctggcggcccaaccgcttccacatgatgaccgccgggctgatctacatgctgttcctgatgatctgggcccggctggcggtgatcatcttcgccgtgtgctttcccagccaacccaccgactggcgttcgctgctggaggttctgcccaccctggacggcatcgccttcatcatcaccagcaccgtcttcggcggtgccctggccaccatcgccttcgtcaccaatgtggtgaccctgccggtcatgctggaccgccacaccgactttttcgccggcgcggccctctcggtgatggcggtggcgcgcaatcccggccccatggtgctgtgggccgccctgctggccggcatcaccggcctgggccttgccctgggtctggtggggctggtggtggctctgccggtggtggggcacgccagctggcacgcctatcgcgacctggtggtgccggaggactgaagccataaacaaaagggaggtttggaggcatcgcctccaaccggggaccggggcgggagccccgccatcgggaacccccacgaaaaagcccgcccctttcggggcgggctcgttcattcacctggaagcggcgcttagtcgtcgcggcgcacgcccatgaactgcagcaggaacatgaacaggttgatgaagtccatgtagagctgcagggcgccgaacaccgccttcttctgggcgacctcggagtgatcgccctcccagtacatctgcttgatgttctgggtgtcgtaggcggtcaggcccgcgaagatcagcacgccggcggcgctcatgacgaagtgcatcatggggctttgcaggaagatgttgacgatgccagcgatcatcaggccccacacgcccatgatcaggaagctgccgaagcccgacaggtccttcttggtggtgtagccgtagaggctgaggccggcgaaggccgccgcagtgacgaagaacacccgggccaccgacgcgccggtgaacaccaggaacaccgaggccagcgacgcgcccatcaggccggcatagacccagaacagggtcgaagcggtcgaggcgcgcatgctgtcgatcttggcgcccatgaagaacaccagacccagcggggccagcatgaacacccatttgagcggcgagtagacggcaatggcggtcagggccggcacgctggcgatcacccaggcgacgatgccggtcaaagccaaagccgaagccatgtagttgtacacactcagcatgtactgccgcagacccacgtcgatctgagcagcctccgcctgggcggcactcatgtatctgcggtctgatccgaaagccatggtcgttcctttgaacactcagttgaacctgcacaccaatatgagggacttccggaaagaatcaagttacacggatttcattcattcctcagtaatggtgcggcctttgcccccagggccttccaggtgccgatgaagccggccagcaggcttgccgccatgcaggcggccagggtggcggcggtggcgccgggcaggaacacccagtcggttttcatgacgtaaagcaggatggcgcgggccgccagcgagcccaccagggccgaggccaggccggtgaccagcccgatcagggcgaactcggccagatgggcccgccacagctggccccgcgtggcgcccaccaccttgagcaccaccgcctcccacacccggcggcgatgcccggccatcaccgcgccggccagcaccagggcgccggccgccagggtgaccactccggccagacggaccgccagatcggcctcggcgatgatgcccttgaccgcctccagcgcctccttgacccggatggaggagacgttgggcagacggtcggtcaccgccttctccaccaccgcgtccatggcgggctcggtgcgcagggtggcgataaaggtatggggcgcgccatccagcacgccgggcgacagcaggaaggcgaaattcatggagagattggaccagtcgatctgacggagcgaggccacctccacctcgatctcgcggcccaggacgttgaggcccagccggtcgcccaccttgaggccgaagcccttggccacggcggcatccaccgaggccagcggcggcccctggtaatcctcgggccaccatttgccctcgacgatgcgcgagccggggggctgggccgccgccgaggacaggccgcgatcaccgcgcgccgcccattccgattcgggggcgatcctggcttggcccaccggcacgccgccgatggacgagatccggccgcgcaccatggcggccttggacaattgggcggccgggtcggtgtccctcaccacccgctccaggtcgtccacctgatcgggctggacgtcgatgaagtagaaggacggcgcctgttccggcagcctttccccgaactgggcggccagattgccctcgaccagggcaatggtcaccagcaccgacagacccagccccagggacagcaccatgcccaccaccgccgagccgggacggtgcagattggccagcgccatgcgccaggtgggaccggcccggcggccgtgccgggcggccaggaccgccgccccccgcgccagcccccaggccaggacgcggaacagcgccagggtggcgcaggcggcggccacgaaccacgcggccaggggacggttggccgccgacagcaccgccagccccgccagcccgccgcccgacagcaccagggcggccagcatgggccagcccaccgaacccggcgcgggcgccgccagccgtcggaacagcacggcggcaggcaccgccttggcccgggccaggggccacagggtgaacaccagggcggacaacgtgccgaagccggcggcgatcatcagggggcggggatagagtccggacttcagcgccaggggaatgcgctcggcgcccagtccggccaccagcgggaccaggcggcgcccgccgccagccccagcaggatgccgagaccggccagcagcccgaccagcaggaaataggtggtgaagatcagccccgacggcgcgcccaggcctttcagaatggcgatggtgccgatgcggccgtccagataggccttcaccgcgttggccacgccgatgccgccgaccagcagggcggtgaggccgaccagggacaggaacgacgccagggtatcgaggaagcgcccgacgcccggcgcggcttcggcggcgtcgcggacctgccagggcgcctcggcgaatctccgggccagttcggccttggcctcggccgggcttgtccccggggcaagaagcaggcgcagggtgtggcgcaccagggagccgggacggatcagcccggtggcctccaccgcgccgttggccaccatcagccgggggccgaaggacagcgccgtggcgatgcggtccggctccttggcgatgacggcattgatgcggaacgtcgcgtcgccgacgtttacctcgtcgccgatcttgagccccaggcggtcgagcagattgccttcggcggccgcaccccaggcgccgtcatgaaaggcgaaaggcgacggcatgggcgatgacagttccagccgccccaccaggggataggcctcgtcaacgcccttcaactccaccagggagcgccgcgcattgccgtccacctggaccatggcccgcatctcgacgccttgggtgacccggcccagcccggccagagccgccagcatctcgggcgcgaagggctggtgggtctggcggatatcgagatcgccacccagcagggcgcgggcatcctcggccagggccgcgtcgaaggcggcgcgcagcgaccccgccccggcgatggccgccacgccgagggcgagacaggccaccagcacgcggaaccccttgagcccgccgcgcaattcccgccaggcaaacttgatcgccaaagagatcacggcttgatcttcccatcctcaacccgcaccacgcgggtacagcgcgccgccagggaatcgtcatgggtgaccagcaccagggcggtgccgaagcgggcattgaggtcgaacagcaggtccatcacggcgcgaccggtggcgccgtccagattgccggtgggctcgtcggccagcagcagcttggggcgcggcacgaaggcccgggccagggcgacccgctgctgctcgccgcccgacaactggccgggataatgggacaaccggtgcgccagccccacccggcccagttcctcctgcgccgcgccgaagggatcggcatgaccggccagttccaggggtaccgccacgttctccagcgccgtcatggtgggaatcagatgaaagctctgaaagacgatgccgatactgtcgcggcgaaagcgcgccagcccgtcctcatccatggggccgaaatcctggcccgccaccgccaccttgcccgaggtggggcgctccagaccggccatcaccatcagcagggtggacttgcccgagcccgagggaccgaccacgcccagggtctcgcccgacgccacctgcaggtcgatgccatcgagaacattgacctcgcccgcaaggctcgccaagttgagatggacggcctccagcgaaaccaggggaaggccggcgatggggcgctgatgcatgcgagggcgactttcttgaacggacggggcgtcttgaccagcataaaccgggacagacgggcggtcttgcgatatggggccgcggcgctgcttgtcaatgcgctgggaggtggcgccatggccggaacggcgagcggacgacgcattctggccctgggggattcgctgaccgccggctatggcctggcgcccgaggaggcctttcccgcccagctggaacgggtgctgcgcgccgaggggcgcgacgtcaccgtgatcaatgccggtgtctccggcgacaccacggcggggggcaaggcccgcctggactgggcgctgggcgccaagccccacctcgccatcctggaactgggcgccaatgacggattgcgcggcctcgaccccaagctgacccacgccaatctcgacgccatcctgaagcgactgacggcggcgggcattcccgtgctgctggccggcatgctggcgccgcccaattacggcaaggccttcgaggccgagttcaaggcggtcttcgcccgcctcgccgccgagcacgacgtggtcttctatcccttcttcctggatggggtggccggcgaccgcggcctgtgcctgcccgacggactgcatcccaatgccaagggcgtcggcgtgatcgtcgggcgcatcctgccctcggtgcgccgattgctggaaaggggaacgccatgaccgccggctccttccgcgtcgcccatgcccggggcgagcattggggaagcgccgccaaggcctgcctcgaccgcctgacccccctgccggagggagccaatttcggcttcctctacgccaccgagctgttcgcccccaatctgtcctccatgctgaccttcctgcgcgagaccacccgcatcgagcattgggtgggcggaatcgcccccggcctatgcgtggctggcgaggaaatccgcgaggacggcgccctggccgccatggtcggccacctgccccccgaccagttccgcgtcttcatcggcgatgccggagactggacgaagcgccactttccctgtgtcgggctggtgcatggcgatccccgcgatcccgacgtgcccaaggccgtcgtcgatctggccgccgaggcggggatgctggccggcggactgatgtcggcctccggcccggccgcccaactggccggcatcgccaccgatggcggcctgaccggcgtgctgctgggctcgggcatcgaggtgctcaccggcatgacccagggctgctcgccgctcggcgccatccacaccgtcaccgaatcctggcagggtgtggtcatggcgctggacggccgcccggcgctggaagtgctgaaggaggaggtgggcgaattgctggcccgcgacctgcggcgcatcgccggctacatccatgtgggcctgccggccgagggcgaggacgaccacgattatcaggtccgcaccctgatcggcatcgatcccaaccagggctggatcgccatcggcgaccatgtggaggaaggcggcacgctgatgttcgtgcgccgcgacgccaacgccgcccgcaccgatctgcgccgcatgctgaccggcctgaaggagcgcctggacggccgccccatccgggccggtctctacgtctcgtgcaccggacgcggcgaatacatgttcggccaccagggcgccgagccggacttgctgcacgaggtgctgggcgacttcccgttgatcggctatttcgccaatggcgagatcagccgcgaccacctgtacggcttcaccggaatcctgaccctgctgccgggggccaagccgtgatccgcctgttcgtgggcatcggcttcgacgaggagctgaccgcccggatcgccacgctgcagcggggcctgcccggcgcccgctggatcgagcccgccaacctgcatctgacgctgcgcttcatcggcgaggtggacgaagatctggccgaggagattcatcgcggcctcgacgccctggtcgagccgcccttcgccctgaccctggccgggctgggcctgttcggagaccgccatcaggcccacacgctgtggctgggggtcgagcgttccgacgcgctgtcgcggctggcggcccgcatcgaatccgccgcggtccaggcgggcgccgagcccgagacgcgccggttcaacccccatgtcaccctggcccggctcaagcacactccgccggggcgcatccaggacttcatcgacgccaccggccccttccgcgaggagcatgtggcggtggaacgcttcaccctgttccgctccaccctcggccgccaaggggcgcaatacgatgccctggagcattatcccttggggtagagcggtccgtcatcccgagcgcaagcgagggatctcctcctgatcctgcggttccgatccgcccccgtcctaccgggcggagattcctcctcccgctggtcgtcggaatgacaggctcgaagggatgcccacatcttggggcagcgcggtaaaatgcaaacattcccttgttccgccccagtcttcacagtattttcaaagccatgatcggctcgtccttccgcattgccttctgtctcgccgtcgccctgggggcggccgcctgcacgcgcggcaccgacctgccgcccagctcggcagccagcgcggggggcgatcagccggccaatttccagttggtcactgacattcccattccgtccggcgccaccatggacaacgaccgctcgctgatcctgtccgatcgcgaccgctggaccggccgggtggtgctgacgctgtacaattccgccaacgaggtcaccgccttctaccagcagcagatgcctaatttcggctggcagcccatgatgagcgtcaccgccgaaaccagcgtgctgacctatgtgcgcggcgatcgcgccgccaccgttcaggtggagcggcgcaccgtctatggctcgctggtgtcggtgacggtggcgcccaagcaatcggacagcagcggcggcggttatgattcggccccagcgccgcgtgcggcaccgtcgggcggcatccgctcggagcaactggctccgccctcgtcccggcgctgattccggcagcaagaaagccccctttcgggggcttttgccatcgacgggaaagccttcggccctacagcaggcgtccgcgcacctcggcgatcagggtggttagggattcgagggccacgccatcgcgggccatcaggcggtgtacgatggggtcggacatgacctcgtccagactcggctccctgccgccgctgtaataggcgatggcgcgggcggagcggccgccgagcgcagcgctgaaacggcgtgcggtcgggacttcggccggttgcggggtggatctgtacgcgcttgacagcatggcagcccccttctttccggatttgacattgactggactatacctgacacgcccaagaattaacagagtcgcattggtatcatttattatgttttttaaggttattttgcggcgcagcaagtattgtgcaacgcggtaactgtttgtattaagctgcgattcaccctgttgcatatggcttctcagcctctggatatcaagaggattcccggccttgtcatcggattttcacagccccggctctctccgccctcatcatgcgggcggaatcgccgccatgctggccgccacctcactgttcgccggcatggatgccctggccaagctgctgatggcggcggattattcggtggtccaggtgctgttcttccgggcggcgttcgggttgctgccgctggttccgctggtgtggcgcggcggcctgcgaagtgtggccacccagcggccgtggacccacgtgatccgctcgaccatcgccctggtggcggtggggtgcttcttccaggccatccaccggctacccctggcccaggtcaccgccatcggcttcgccgccccgctgctgatcaccgccctgtcggttccgctgttgaaagagcacgtttccctgggccgctggctggcggtggcggcgggattcggcggcatcttgctggtggcgggacccgaggcctgggccggcgacctgctgggcctaggtgccgccctggccgtggccggaaccttcctctacgccctggtgatcgtgctgatgcgggtgatgggccggaccgaggcggcggtcaccacggtgttctggttctccgtcctgaccatgatcctgtgcggcgcggcgctgcccctggtgtggcggacgcccgacacccaggcctggggcctgttcgccgccaccggcattctgggcggaatcgcccagttgctgatcagccaggcggtgcggctcgccccggcgtcgctggtggcgcccttcgactatttccacatcgtggtgtcggccagcctgggctggctgctgttctccgaaattccgactctcaacacgctggccggcgccctggtggtgatggcgtccggcctttacgtgctgagaagcgacaagggccgctgaccccggccgcccgggggacggatcagtgagccgagactccttccgcccccagcccggtctgcgaacggacgaactgggcattaaactcggccttctcccgcaccgcccgctcgctgccgtcggtgaccgagaagaaccaggtggcggcgaaccccgccgccaccgagaacagggcgggattgccccaggggaagatgggctgggggttgcccagcacggctttccacaccgccggccccagcacggtcagcaccaccgccgagaccagcccggcaacgccgcccaggatggctccgcgcgacgtcaggcccggccacagcatggacagcagcagcagcgggaaattggccgaggcggcgatggccagggtcagaccggccagataggcgatgttctgcttctcgaacagcatgcccaggatgatggcgatcacgccgagcgccagactggccagccgcgagatgcgcagttcggtctcctccttggcgtggccgcgggcgaagacgttggcgtagagatcgtgggaaatggccgaggcgcccgccagggtcagccccgccaccacggccaggatggtggcgaaggccaccgccgagatgaagcccaggaacaaatcgccgcccaccgcatgggccagccacacggccgccatgttgccgccgcccttcagcgccttgccgtcggccagataggtcgggtcggtggccaccagggcgatggcgccgatgccgatcaccaccgccagcacatagaagaagccgatgaaagcggtggcgtagaacaccgatttgcgtgcctccttggcgtcgggcaccgtgaagaagcgcatcaggatatgaggcaggccggcggtgccgaaggccagcgccatggccagggaaatggtgtcgatggggtccttgaacagcaggcccggcgacatgatggcgttggagcccttgacctgaacggccttggcgaacatggcctcgggcgagaagccgaagcgggacagcaccgcccccgccatgaaggtggcgcccgacagcagcagcaccgccttgatgatctgcacccaggtggtggcggccatgccgccgaaggtgacgtagatcatcatcagcccgcccaccaggaacagggcgtacaggtagtccatgccgaacagcagcttgatcagctgcccggcgccgaccatctgggcgatcaggtagaacaccaccacggtcagcgagctgaacgccgcataggtccgcaccggcaccttggccagacgatacgccaccacgtcggcgaaggtgtacttgccgaggttgcgcagcggctctgcgatcaggaacagcatcagcggccagcccaccaccacgcccacggcataaaccatgccgtccaggccggtgccgtagagcagggcggtcacccccaggaaggatgccgccgacatgaagtcaccggcgatggccagcccgttctgaaagccggtgataccgcccccggccgtatagaagtccgccgccgatttcgtgcgtttggaggcccaccaggtaatgcccagggtcagcaggacgaagcccacgaacatcaggatggcgtgccagttggtagcctgccgggcagcctggccgagatcggcgccggcggccagcgccggcagggacggggccagcagcatcagggacagaacgccgaggcggaggaagtgggacatgggacggcctctccgggctaattatggtattttggtacctgtttacttatttcattcctcccgcgcaagctttacgcgccgcctctcccgaacagccatcgaatccgcttggcctgtctttccgcgccgcgtatgctgcgccagaacagaacgaagtcgcataatctttttgtccgagagggaaaccggtgtccaagcgcctgaccgcaagcctgatcgcctgcgccctgggatggctgcccacgatggcagacgcccacttccaggagctgattccctccgccgatatcgtcggcgagcaaggcccccgcgacattcgcctggatctggccttcacccatcccatggagcaaggcccggtgatggagatggccccgccgatgcgcttcggggtgatggccggcggcaagacccgcgacctcaagcccaccctggcggcggccaagcggggggacaagacggtgttcggcgccggattcagcctcgaccagcccggtgactacgtcttcttcgtcgagcccgccccctattgggagaaggccgagggcaagtggatcatccactacaccaaggtggtggtggattttgcgggcggcggcggctgggacaagccggtcggtctgccggtggagattgagccgctggtccggccctacggcctgtggaccggcaacctgttccggggcatcgtgcgccgcaacggcaaggccctgcccttcgccgagatcgaggtcgagtggcgcaacgacggctcggtcaaggcgccgtccgatcccttcatcacccaggtgatcaaggccgatgcctcgggccagttcgcctatgccatgccccgcgccggctggtggggcttcgccgccctggtggagagcgacatgccggccaaaagccccgcgggcaagccggccaagaccgaactgggcggcctgatctgggttcgcgcccaggacatgaagtagcggggaggcaccaccccttggcccatatccccgatggcgtgttgtccggtccggtgctggtggcggggggactcctcgccgcggccggagtggcgcgcggcctgaaggagctggagccggtgcgggtccccaaggtggccatgctgtcggcggtgatgttcgtggcctcgctgattcatctgcccgccggccccgcctcggtgcatctgctgctcaacggcatggccggaatcgtgctgggctgggccgcctttcccgccctgctggcggcgctgctgctgcaagccgtgctgttcggcttcggcggcctgctggtgctgggggtcaacaccgtcaacatggcggtgcccgccgtgctgaccggtctggccttccgccgcctcgccaaggaggcgccgccacgccgcgccgccctggccgccgccgtctgctcagggagcgccgtgctgctgaccgggctgatggtcgccggatcgctggcggcgtcgggccgcgaattcgaggccgccgcccggctggtgatgctgagccatctgccggtgatggggatcgaggcggtgttcgcctcggccgccatcggcctgctggcccgggtcaagccggaggcgctggcatgaagcgtcttgccgccctcccgatcctgctgctgctggccgcccccgcccaggcccacaagctgaaggttttcgcttcggtggaaggcggcgacatcgtcggctccgcctatttcgtcggcggcgacaaggcggtgggcgtgcccggccgcatcctgggcgccgacggctcgctggtcgccagcttcgccaccgggccggacggcggcttccgtcagagggcggcggcccgcatggaccataccatctcggtggaatccgaagacggccacgccgcccggttcatccttcccgccgatcagttcccgccatccctgcccgagggcaaggcgatggcggcgccgtccggtgatgccgccgccctggaagccgccatcgcccgccagatccgtcccctgcgcgaacagctggacgcctatgagtcccgcacccggctgcacgacgtgatgggcggcatcggcaccattttcggcctgttcggctgctgggcctggctgcaatcgcgacggagcaggtcatgagtctgatcgaacggcttgacccccgcacccggctgctggccgccctgttgttcgccctggccgaggtgctggttccctccctgatggcgcaatgcgccggattggcgctggccgtggccgccgccatggtcgcccgcctgcccctgggcgccaccctgcgccggctgctcggcctggagggcttcatggtcgtggtgctgctcatgctgcccttcaccgtgcccggccagccgctgttcagcctgtggggactggacgcctcgcacgagggattgcgtcaggcggcctccatcgcggtcaaggccaatgccgtggcggtggcgctgttcgccctgctgggctccatggaggcgcccgccctgggccgcgccttgggccgcctgggggtcagcgaacgcttcgtccatctgctgctgttcaccacccgctacctgtcggtgctggaggatgagtatcgccgcctgcgcctggccatgcgggccagggcgttccgccccaccaccgggccgcattgctggcgctcggtcggctatctgttcggcatgctgatggtccgttcgctggagcgggccgagcgcatcgacgccgccatgcgctgccgcggcttcaccggccgcttcccctccctggacgacgagtccccgaccgggccggggcggctggatctgggcttcggcgccgcctccgtggccggtctggtcctggtcatcgccgtgggggtggcgtgactctcatccgcctggagcaggtcacccacgccttcgataccacccatccggtgctcgacggcgtcgacttccaactgggcaagggcgaaagggtggcgctgctgggggccaacggctcgggcaagaccaccttgctgcacgtcatggtcgggctgatccgccccaaggccggcaccgtgcacgcctttggccgcgagcgccgcgccgaggccgacttcgtcgaagtccgcgccaaggccgggttgctgttccaggatgccgacgaccagttgttctgtccgacggtggccgaggacgtggccttcggccccctcaatctggggaaaagcaaggccgaggcccgcgagatcgtccacgccgtgctcgcccgcctgggcctcgccgccctggaagaccgggtcacccacaaactgtcggggggccagaagcgtctggtgtccctggccgccgtgctggccatggagcctgacgccctgctgctggatgagcctaccaacgccttggatgaagcgacgcgggaaaggctactggacatcctggccgggctgccccaggccatggtcatcgtctcccacgatcgcgaggtgatcgagcggttggccacccggcgggtgacgctggcggggggccggttattgggctgtcgcccaaacccacccggggccaatgccccggaccccatttttgagtcatgaataaaagggtggtctggaggcatcgcctcctgccggggaccggggcgggagccccgtcgccatatcagcctgaaatggagaccggcttggaggtcggccccagggcctccagcgccttcttcagccggggctgggattccaggcgcgacggcccggcttcgacaccgcccacataggcggtggacagcaaggcggaatagacccgcttcatgtcgtccaggcaaggcggcggcgtttcggcgttggtcaggcggtcggccagcttgcgcgccgcgtggacctgtccggtctggcagaaatcctgcttgaagcgctgctcgcccagggtggtgaaggcgatcatcagaaaggcggtgaagcgccggatgtcgccgcccagcaccggcagcagcgaccggatcacgtccacatgggtgttcgacacctgggagacggcacggcggatcagcgaggtctcggaactggggaacagacgggccagatccatctgctgcaccacccgccacaggatctcggactcgatgacctccttgccgggcaccatcagccgcttggcgtcatcgagcagcagcggcacccgcccatcgcgcggcacgttgcccggcgcgctgagcgcctgcaactcggcggcctcgcggatgtcgagcaggcgcgagcccagatcgctgaccagcgagggactcatgggggtgtaatgggggatcagcatgacctgccagtcaaagcgcaggtaatcgcggatcacctgatacagggcctccgaacgggcgtggggcttggccgcatgcttgtggaccggcgtcggatgagccagacccagggccagacccatgcgcttcatcagggacagcttgggcggcggagcctgaaacttggagcggaaatccaacttggcgcggaaatagcggcgcgccgaagcgcgcaccacaagagccaccgcctcggccaaggtgcggccacaggccagcacgtcatggtcggcagtgatcggctgcttcgccgcatcggtcaccacattggcgaacagctccggccgggtccggaacaggcgcagacattcgtcgagcatcttggggtcgttcatggccttgtcgtaggcggcgttgcgcggcagccccttgagcgccagcacttccttgcgcagcacctcgatcaccggaccctccagcgcggcgcggatggcctcgatccccggatccgcattggaccatcgggtcgctggaccagtcttccctgtctttgccgacttgtgtccgggcatgctgttcacatctcaagtctacgcattcacaacccattcacggtgcgcctgtaaacaggagaaatcaacacatataaaggagtgatcacttatatcacattggtcatgcctttgttgattttacaaatacatgccgatacctttgaataaaattttatccaattttattgcttataccgcccattaattcgccgccaaggttccgatttacctccggccagggtagaatggcgacgcgtcacaggagcgggagagaggcggatgcacggcggccaccaccacgacgaagccaacgggcacgagcacaagcatcaccacgcccacgagcatagccacgtccatacccacccccattcccatggggacgtgacccacacccacgcccacgcccatacccatgagcacgaccacctgcaccagcacagccacccccatggccatgacgacgacagcggccatgaccacgatcaccagcaggccaagcacgcctggaagccgcacgagcataagcacgccgaggaagacctcggcggccacaaccatgagcactgattagggaaaaaacggggacggtcagtcctcattttccagcgaggcgacatagcgcaagccgtccagcgcggtgtcgaaccagtcctcgcgggtttcgtcctcggcgtggaccagataggccgggcggcggaattccggcgccccggtgacttcgaacagccggcccgccgacaggtacgagcgcaccacccgcatggggaaatagccggtgccgccataggccaggacgtgttgcagccccaaggcccccaagcccacctggaccgccggcgtcttgagatcgggaaaagcctgactgtgggcggcgcggaattccggcccccagtccaccagaacgtaatcctcgtcccattccgccacggcgcgccgccgggtagaaaccaggaccaaacgctcttccagcagcttctcgatgtgcaggcccggacgcgacagcggcgaatacatcaccaccagatccagcatgccctcgatcagctggcgcatcagactgtcagatcccccgacctcggccttcagcgccacgtcgggcatggcggtgcgcatccagggaatccactggaccagcaggcggtcccacagggagaactggccacccacgttcagcacggtgcgaaatcccgccggcagggccagttcctggcgcgcctgctcccagacccggaccatggtggtggcatagcggcgaaactgcatgccggccgcggtcaactgggtgcccgattttgagcgcacgaacaacggccgccccagctcttcctccagggcgcggatgcgcatgctgaccgtcgactgggtcaccgacaatcgctcggcggccttgttgaagtttccggtgtcgacgatttccaggaaggtgcgggcgagatcgatattcatgatgcggccagaacggaggcagcattatgctgcgctgcaatagaagcagcgttttatccgaaccgcgcggaaacttcaactaccccgcggctggtaatcggaaagtttgatgcatgggtgggaagaccccacccatgcgagcgggaatgacttaggcgttcgcccgggccttgacgttgccgcggctgcgatcgacgtattccttcaactggcgctccatgccggcaaaagcctcgcgcagcgccacatagatatcctcattgacatggctgtccttgggatcgcgcttcaccaccaactcgtcgccggggaccgtcagggcgagacggatatggaagggctcgcccttgtggtgcaggttcgaggtgttcttgtggtgctgctcgatcaccacgcggcagctcgtgatgcgatcgaagagatgctccagtttggccaccttttcgcgaatgcgggtttcgacagcatcggagtgatcgacaccgtgaaaggtgatctggaggggaatctgcatcaacgtctccattctctcggttcgcccttgccggactgattggcagcggccgggcgactcggttcctttatcaatcccgccgtctgggcgggaccttgaagctcggggcgccatacatagccatttacaatggtcttggcaacgtccggagcgaaccttcattgtctcggagaatcgcggcacttgcaagctggcgccgctcccctcatatcagagcgcccattcttgcaacccctaactccgggagacggaaccgtcatggccgaagaaaagcgtcaattccaggcagaagtcggcaagctgctcgacatcgttgttcactcgctctactccaacaaggagatcttcctgcgcgagctgatctccaacgcctcggattcatgcgaccggctgcgctacggcgccatcaccgagcccgacctgctggacggcgattccgagttccgcatccgcctggtccccgacaaggacgcgggcaccctgaccatcatcgacaacggccagggcatgagccatgacgagctgatcgccaatctgggcaccatcgccaagtcggggaccagcgaattcctggcccgcctgaccggcgacgccaagaaggacgtcagcctgatcggccagttcggcgtcggcttctattccgccttcatggtggccgaggaggtcaccgtgaccagccgcaaggccggcgaggccaagggctggaagtgggtgtcggacggcaagggcgaattcaccgtctcgcccgccgaggatgccgcgcgcggcgccgccatcaccttgaagctgcgcgaaggcgagaccgagttcctcgacgccttccgcctcaagtccatcgtcaagcgctactccgaccacatcgccattccggtgacgctgaaggacgcagacaaggacgaggagaccatcaactcggccagcgccctgtggacccgatccaagtcggagatcacccccgagcagtacaaggaattctaccaccatgtggcccatgccttcgacgagccgtggagcacgctgcactacaaggccgaaggcgccatcgaatacaccggcctactgttcattccgtcgtcgaagccgctggacatcttccaccccgaccgcaagcagcatgtgaagctctatgtgcgccgggtgttcatcaccgacgattgcgaagagctgctgccgccctatctgcgcttcgtgcgcggcgtggtggacagccaggacctgcccttgaacgtcagccgcgagatgctgcagcacaaccccgtgctgtccaagatccgcaccggcctggtcaagcgcatcctgggcgagctgaagaagaagtccgaggatgccgagggcaagtatgacgagttctgggccgccttcggtccggtgctgaaggaaggcatctacgaggatttcgagcgcaagaccgatatcctggaactctgccgcttccgctccacccatggtgacggcctgaccaccctggccgattacgtggcgcgcatgaaggacggccaggacgccatctacaccatcaccggcgatgatctcgatcagctgaagaagagcccgcagctcgaaggctttgccgccaagggcgtcgaggtgctgctgctcaccgatcccatcgacgagttctgggtctcggccgtgcgctcctacgccgaaaaggacttccgctcggtggccgccgccggggccgacctctccaaggtcaaggcgcccgagggtgccgaggacaagaaggcggacgaagcccccgccgacgaactcaccaccctgatcgaggcggtcaagctggccctgggtgaacgcgtcaaggacgtgcgcccgtccgaacgtctgaccgaatccgccgtctgcctggtggccgccgagggcgagatgagcatgcatctggaaaagatgctgcgcgcccataaccaggccccgggcgagcgcgcccgcatcctggaaatcaacccccgccacgccctgatcaagggcctcgccgcccgcgtcaaggccggcggcaccgatgccggcctggaagacgccgccttcctgctgctcgatcaggcccgcatcatcgaaggcgagccccccgccgaccccgccgccttcgcccggcgcatggtgtcggtgatggaaaagggcctgctggggtaaaaggcgaaaatagggaaccgtgcgaagggactcgtcccttcgcgcatccctgttcattggatcggaggtctggaggccccgcctccaggcgggtccgggcggcagcccgggagacgccgtaaggcgttcctcgccctattcctccgccatcaccctgttccgcccggaattcttggcgcgatagagggcctgatcggcgcgttccaacatggtctcgacggtcaggtcgccttcacgcaactgggcgatgccgatgctgacggtgaggtcgaacaattcgcccttggccgggcgaaccaccagttcctccacggcggcgcgcaggcgctcggcgatgacgcgggcgccgtcggggccggtattgggcagggccacggcgaattcctcgccgccaatccggccgagaatatcgtattcacgcagggacagccggcaggcattggcgaaggccttcagggcctcgtccccggcggcgtggccccaggtgtcgttgatgcgcttgaaatggtcgatatccagcgccagcagggcgaaggagcggcccatgcgccgggcgtggtccagttccagcccggccagatgctcgaaatggcggcgattggcggtttgggtcagggaatcgcggctggccagctcttccagctcggccatgtggcggctggtatcgcagaaggcgcccagggacagagccaggtcctcgatgccgccatcctcggccagcaccaccggcacccggtcgatgaccagatgcagcagcgcctcgcccccttgcgccggcggcgggacatccacgggataggcccccaccaccagccggccgtttccggcgggcagaaccagcctttgccaggtctgcggcaggtcctgaccgaacagggcagtgtaggagcgccacagggggcgcccggtgcggcgcacgaagccgtactcgaattccagcatgaagcgccggtcagcgggcaggatgtcggcgggcagcaggtcgatgacctgcccggtcaggtcctggccgaagcaggcggtgaaggcgcggccgtaatgggcgtagcggttggcgccgccctcggtctcgatgaccagcaggtgatcggcgtgggcggcgaaataggcggcgggatcgccctccaccgtctcggcctgccgccactgggacagcagggcggacagacgggaatccatcacttgcacaaccagatcacgcatggaatctcacccttgccatgccctactggtatcacaggatcaggctttcgaccagttcccggcggtctggaccggcatcggaaacctgcgtatggtgtcggccatcggaatggagggagagtgccgtcttgacccacgtcaacgcggacaatccccggccaagccagtctggacccatgcccggcctgccccgaaccctgtttctcgccacccggcccatgttcctgcccgccgccctgatcccggtgctggtgggcagcgcctggggcatccatcgcgcccatgccgccgacccgctggccctggccctggcggcggctgccatggcctgcctgcacgcgggcgccaacgtgatcaacgacgtgggcgacgagttgaatggcgccgaccgcctgaatcaggaccgcatccctccctttaccggcggctcacgcttcatccaggaggggaggctcggcctgcgggccatggcgctgtggggcgtggccctgctgctggcggcggcggggctgggcggcatcctcagtctggccaagggcgaatgggtgctggccttcggtctggtgggcggcgccctggccctggcctattccctgccccccttcagcctggcgtcgcgcggcctgggtgaagcggcggtggccctgggcttcggcctgccggtggccgcctgcttctggctgcaaagtggcagcgtggggctggaggcgattttatgctcggccatcgtcggtgcctggaccgccgccatcctgatcgtcaacgaagtgcccgatctggccgccgatgcccaggcgggcaagcgcaccctggtggtccgcctgggggccaagggggcgccgtcgctttatctctcggtgcaggcggtggcctcggccctgatgctggcgctgggctggctgtcgcaattgccgccctgggcggtggtgccgcccctgctcaccatgctggccgccctggccgccaccccgctgatggccggcgggcgggcgggccagttggccgccatccgcattaccctgggcatccatctgctgggcgggttgtgtctggcgggagcggcattcctgggatgagcggggctcccgccccgactccggctggaggcgatgcctccagacctccctttcattcacaaatcaaacgttgaacaggaagtggaagatgtcgccgtcctggacgacgtattccttgccttccaggcgcatcttgccggcttccttggcgcccgcctcgccgttgcaggcgatgaagtcgtcataggcgatggtctcggcgcggatgaaaccgcgttcgaagtcggtatggatgacgccggccgcctggggggccttgcagcccttctgcagggtccaggcgcgggcttccttggggccgacggtgaagaaggtgatgaggtgcagcagctcgtagccggcacggatgacgcgggcgaggcccgtctcttccagccccagggtttcgaggaattccttgcgctcttcctcggaggccagttgggccacctcggattcgatggcggccgagatcaccaccgagctgttgccctcggcggcggcgaacttggcaaccgcttcggagaacttgttgccggtggcggccgaggcttcatccacgttgcaggcgtagaccacgggcttgacggtcatcaggcccagggtcttggcgatgcggcgctcttcctcggtgtcgaaggtgatggtgcgggcgggcttgccttcgcgcaagcaagccagcagcggggccatgacgtcgacctgggccttggcctccttgtcgccgttcttggccttcttctccagggggacgatgcggcgctccagcgagtcgagatcggccagcatcagttcggtctcgatggtctcggcatcgcgcaccggatcgaccgagccctccacatgggtgatgtcgccgtcctcgaagcagcgcagcacgtggacgatggcgtccacctcgcggatattggccaggaactggttgcccaggccctcacccttggaggcgccgcgcaccaggccggcgatgtcgacgaattccagctgggtggggatttccttctggctcttgccgatgaccaccagcctgtccaggcgcgggtcgggcaccgccacgcggcccacattgggctcgatggtgcagaaggggtagttggccgcctgcgccgccgccgtcgaggtcagggcgttgaacagggtgctcttgcccacgttgggcaggccgacgataccgcaattgaaacccatggactcagtccttcctgatgatcttggtcatggccgccttcagcgcctcggcgaggctgccgcccgacggcggagcggaaacttgggccggagcgggggccggcgccgcttcggcggccggtctgtcctttttcggcttgggcggcgcggtgaggtgcgccacccgggtcgcgaagccggcatcgtcgcccgacaccagcatgggaaaggtatcggccacggcgtcgagcaccggcaccagccaggcctcgtccgccttggcgaagtcgtgcagcacgtagcccgacaccagatcgcggtcgccgggatggccgatgcccagacggacccggcggtaattctgtcccagatgggaatcgatgctcttcagcccgttatggccgcccgcgccgccgccgcgcttgaccttgaggcggcccggcgccacgtccagctcgtcatgcagcacgatgatgtcgtccaccggcaccttgagaaagcgcgcggccgccgccaccgactggcccgacaggttcatgtaggtctggggcttcaaggcgatgaccttctcgcccccgatgatcccttcggccacttcgccctggaacttggagcgccagggcccaaaggaatagcggcggacgagaacgtccgccgccataaagccgatattgtgccgattcctggcgtagtcggagccgggattgcccagtccgaccaccaggagcatttagccggcagcctcggtctcggtggtctcggcacgggccacggtgggggccgcgatggaggccacggtagcgcccgacgccacgtggtagggcttggcacccgccggcagcttcagatccgacagatggatggaggcgccgatttccaggccgtccaggtcgatcaggatctcgtgcgggatatcgttcggactgcaggtgatctcgatttcgtgcagctcgacgttcagcacgccgcccttcttgatgcccggggacttcagctcgttggtgaagtggaccggcaccttcacatggatggcgtggtcggccgagacgcgcatgaagtcgacgtggatcggctgatcggtcaccgggtgcatctggacgtcacgggccaggcaaaggtgcttgccgtccttgccgagatcgacgttgaacagctgagtgaagaaaccggtcttgctgatctgggcccaaacgacgcgggggtccatctgaatgcagatggcggccttcttgtcaccgtagatgacaccgggaaccttaccggcacgacgagtggcacgggcggccccctttccgcttccgtcgcgcagctcggcggcgatggcgattgcttcggacattgtactctcctgacaaacgaatatatgcgcggcctccaggggtgccacgcggaagcgggtcgtttacaccggttgcgtccgcttggcaagggtaagtagactcctttcgttcctcggataaggcctgtcccatgacgcttgatgccccccgttctgattccccccgttccgattcacagcgcccgcgatgacgggctcggcacgcgacgtcctggcgcaaaagggcttcaggctgtttctcaccgcccggctgctatcctccctggcccagcagatcgccacggtggcggtgggctggctggtctacgacgtctcgggagacccgctgcaactgggtctggtcgggctggcgcaattcgtccccgccctgctgctgaccctgccgggcggccatctggccgaccgggccgaccgccgcctgatcctgctgtgcgccacgctgctgaccatgctggccatgggcgggctgctgctgctcagcctggagggcaagcccagcctgcccgccatcttcgcggtgatggcggtgctcggcgccgtgcgggccttctgggcgccggccgggcaatccatgaccgccatgctggtggagcgccatctgctcagccgcgccgtggcgctcaactccacaatctggcaggtcaccgtcatcgccggcccggccatgggcggcctgctctacgccttcggcccggcggtggtgttcggcagcgccaccctgctgctgggctcggccgccatcgccgtcttcctgctggcgcccatgccgccccacggcctgggagagcggccccacatcctggacggcatccgctttgtcagaagccggcccgagatcctgggctccatctcgctggatctgttcgccgtgctgctgggcggcgccaccgccctgctgcccatctatgcccgcgacatcctgatgaccgggccgctgggcctgggccttctgcgcagcgccccggccatgggcgccgccctgtccgccgccctgctggcccaccgcccgcccgaacgccacgccgggcacaagctgttcatcgccgtggcggtgttcggcctgggcaccatcgttttcggcctgtccaccagctttcccctgtccatggccgccctggcgatcctcggcgccgccgacatggtcagcgtggtgctgcgccagaccttggtgcagatcaacacccccgacgacatgcggggacgggtcagcgccgtcaacctggtgttcatcaccgcctccaacgaactgggcgagttcgagtccggcgtggccgccgccctgctgggcaccgtgcctgcggtggtggttggcggcgtgggctgcctgctggtggcgggagtctgggcgtggcggttcccggccttgcgtaatttcgaacttccccggagtcatccatgatcgccttccccgatccccgtcttgccgcccagatcgccttcgtggtcgagatcgacaagctgaagggagtgctgcgccagacgctactgatggattcctcccggcgcgagaacgacgccgagcattcctggcacatcgccaccatgtccttcctgctggccgaatacgccgaccagccggtggagatcggccgggtggcgcgcatgctgctgatccacgacatcgtcgagatcgatgccggcgacaccttcatccatgacgaggccgggcacgaggacaaggaagagcgggaaaggaaggccgcagcgcgcctgttcggcctgttgcccgccgatcaggccggcgagtacagcgcattgtggcaggaatacgaggcgcgccagacggcggacgcccgcttcgccgatgcgctggaccgtctgcagcccctgctccacaatttcgagaccggcggcgccacctggaagccccacggcgtcacccgggccaaggtggacaagctgacgccgcgcatcgcggcgggatcaaagcgcttgggcgcctatgcccgcgccctggtggacgaggcggtgcggcggggctatctggcgccgtagcgtagccgttgcacgggacgggtctgggcggcagccctagactcgcttgccgaaggtcggcggccctctccgcgtcaggacgggaggagcgtcgtccgggaccggtcccgggtcggcgaagagcggctcaggatggggaaagctcggctcgggcatcgccatgggccggcgcacgctgaccaatgccagccggaattccccgaaatcctttcccaggatcagcttgaacggaacgagcgagaaggccagccccaggaccacgccggccggtcccacgatagcggcggcgctctggtgcgaggcgcccgcgccgatcatggcgaacgtcaacagaagcgagccgacgaagccgacggcgccactcaggatgatggccagcaggttgcgccagagataggcccaccacaccctcagggttcgcccccaggttacctcgagttcgaccatgtcaccctcccctttaatggcgccatgaccattatctacagggattggtggcgccgatctgtgagaggcgcaacactgggcgtgatcggcaacggttcaatcggcggcgtcagtccttcctcgccaccatgaacagccggcggaaggggaacagggtcttgccgtcgggacgcggcgggtaggccgcctggatgcgccgggcgtattcggccagaaagccggtggcccaggcgccgtccaccgccgtcatcaaggggcgcagcgccgtgcccttggtccaggtgaccaccgggttgtcgccttccagcacgtgcaggtactcggtctcccagatgtcgatatgggaggaatgggcggccagcaggtcataataaaaggaaggctcgcccaccgggaagcgggcggccagggggccgagcacctcggcccacggcccggcagaggcggcctcggccatgatggtgtgggaggcggcatagtggttgtggggcatctgcaccgccagcacgccgcccgaactcacccgctccatcagcttgggaaacagactgtcgtgcccatccagccaatgcagcgcggcgttggagaacaggatgtccacctcgccgccgttttccgcccagccggcggcatcgccctcgagatagcgcacggcgccgccgtgatcgcgcgcggtcatcagcatctcgggcgaggaatcgatgccgatgacgtcggcgtccgcccagcgttccttaagaatacgggtcacgttgccggtgccgcatcccaggtccaccacccggcgggcgtcggccaggtcgatacgggccatcaggtcgagcgccggacgcaggcgcggctgggcaaaggcggaatagatggcgggatcccaggccatgtcgggcggctcctcttgaaaattgccccagtgtagccgttcgggctgggttctaaaaccggcgagcgcttattcctgtcatcccgagcgccggcgagggatctccgctcggcatggaggtgccggttctgaaaagccgagccagaacgagatccctcctcccggtggtcgtcgggatgacacgttaccccgacagatcgtcgataaaaaacccgtgcactccgcgcattgactcttagggtcacccggcttatacacgtccgctcattttcaagtccgttcagtttggagtacctcccgtgaagcgtacctatcagccgagcaagctcgtccgcgcccgccgccacggcttccgcgctcgtatggccactgtcggtggccgcaaggtcatcgccaaccgccgccgccagggccgcaagaagctgtccgcttaagtccccatggccgcgcggcttgatcggcttaagaaacgggccgatttcctgcgtgtcgcggccctgaggcgaaagtgggcggcgccgggcctgattcttcaggccgcgcccgcatccggaacggatttgcaagccgactcgctcagggtcggcttcaccgtttccaagaaggtgggaaattcggtgtgccgcaaccgggccagacgcaggcttcgggaagcggtggctcaggtttttccggctcatgccagcgcgggcctcgattacgtggtgatcgggcgcaaggagacgctggaacggccatattctcttctcttgcaggatttgctggcggcgttaaaacgtgtcggcgcgctgcaaaagacgcatgctgccgaggcgcccgataccgcctcaccacagagctgaggcttctcagttctgtggtgaggcggcaagggcaaggcccgccgcggcttatgccgcgaaagcctagcgaagcgcccggcgattgagggcaatacggcggaccggtttaccggtgcgccggtaacgaccaggagtggcatgaaccccatcggtctgggaatgcgcggtctgatccgcctgtaccagctgctgctgagcccggtgctgccggccagctgccggttcacgccgtcctgttcctcttatgccatgcaggccatcgaggcgcacggacccgtcggcgggacgtggctgggcctcaagcgtatctgccgctgccacccctggaacgacggtggctatgaccccgttcctcccgctcataccgaaagaggcggcaccatgtgcccgtcgcgactgccggaataggatgacatgaacgaccagcgcaatctcttcgtcgccatcgccatttcggtcgccatcctgatcggctggcagtacttcttcccgacggccaagccgccggtggaacaggccgcgcaacagcaatcggccgagcagaaggcctcggctccggcgacggcgcccaccccggccacggcgtccagcccggcccaggtgcccggctcgcccgccgccgccgccgcccagcccgccgcgacccgcgccgacgccctgggcaagagccgccgcatcgccatccagacgccctccatgcacggctccatcgcgctgaccggggcccgcatcgacgacatcaccctggtcaagtaccgtgagacccccgccgccgattcccgcgagatcgacctgatgtcgcccgccgaatcgcctgagccctactgggccgaattcggctgggtggccaccgaggcgaacgtcaaggtccccggccccgattccgtatggcaggcccagggcagcggcccgctgaccccagcctcgcctctggtgctgacctgggacaacggcgaggggctgcgcttcgtgcgcacctataccgtggacgagaattacatgttcggcgtcgcccagcgcgtcgagaattacggcaccaagcccgcctcgctgcacccctacgccctgctggcccgcaccggcaccccgcacgtggccggcatgtatatccttcatgaaggcccgctcggcgtgttcgacggcaccttgaaggagatgaagtacgacgacctcaagaaggaaggctcgtcgcgccacaagaccaccggcggctgggccggcatcaccgacaagtactggctgaccgccctggtgccgcccgccaagaccgagatcaccggccgcttcgtgcatcagcgcctgggcaatgccgaccggtatcaggtggattatctggctccggcccgcatgatcgagcccggcaagtccgaggaagccggctttcacctgttcaccggcgccaagcaggtcagcctgctggacggctatgccgagaagttcggcatcgaccgtttcgacctggccatcgatttcggctggttctacttcctgaccaagccgttcttctacctgctgcagatgctgcacagcgcgctgggcaacatgggtctggccattctggcgctgaccgtgatcctcaagctcgccatgttcccgctggccaacaagtcctatgtggccatgggcaagatgaagaagctgcagcccaaggtgcaggaactgcaggcccgctacgccgacgacaagatgcggctgcagcaggagatgatggcgctgtacaagaccgagaaggtcaatcccgtctcgggctgcctgcccatcatggtccagatcccggtgttcttcgccctgtacaaggtgctgttcgtcaccatcgagatgcggcacgcgccgttctacggctggatcagcgacctgtcggcccaggaccccaccaacatcttcaccctgttcggcatgatcccctggacgccgcccagcatgttccacctgggcgtctggccgctgatcatgggcgtcaccatgttcctgcaacagaagctcaacccccagcccaccgatccggtgcaggccaagatgatgcagttcctgcccatcatcttcaccttcctgctggccaatttcgcctcgggcctggtgatctactgggcgtggagcaacaccctgtcgatcctccagcaatgggtgatcatgaagcgcgccgaggagaaataggctgaacgagtccctcctcagcgacgagcaggagaaggccggtctcatcgaggccggccggctgcttttcgcgcgtgaatgcatcttcatgcaaggcgcctccgggctggatcacctgccagcggccacgctgaccgaagtggccttcgccgggcggtccaacgtgggcaagtcctcgctgatcaacgcgctgaccggccgcaacaccctggcgcgcacctccaacaccccgggccgcacccaggagctgaacttcttcaatctgggcggccgcctgatcctggtggacatgccgggctacggcttcgcccaggcccccaagggactggtggagaaatggacccggctggtcaacggcttcctcaagggccgctcggtgctgcgccgcgccgtggtgctggtggattcccgccacggcctgaaggacagcgaccgcgacatgatgaagatgctcgacaaggccgccgtggtctaccaggtggtgctgaccaaggccgacaagctgaaggccgccgagctggacgccgtccaggcccgcaccctggaagagatcaagggccgcgtcgccgcccatccccacctgatcgtcaccagttcggaaaaggggaccggcatccccgagctgcgcgccgaacttgcctctctcgcctgaggagcgtcatcccatgagcaccaccgacacccccgacatcatgcatgaccgcaaggcctggctggaccgcgccaagaccctgtccgaggcgctgcccttcatgcggcagttcaacgacgagacgctggtcatcaagttcggcggccatgccatggaatccgatgatctggcgcgcctgttcgcccgcgacgtggttctcttgaagcaggtgggcatcaatccggtggtggtgcacggcggcggcccgcagatcgacgccatgctgaagcgcctggacatccagacgccgcgcgtcgacggcctgcgcttcaccgacgaggccaccgtcgaggtggtggagatgatcctggccggcaagatcaacaagcagatcgtctcggccatcaacgaggccggcggcttcgccgtgggcctgtcgggcaaggacggccacctgattcgggcgcgcaagctgcgccgcaccaagaaggatccggattccaacatcgagaaggtgctggacctgggcttcgtcggcgagccggccgaaatcaatccccacatcctcgaccagttcaagaagtccgacaccattccggtgatcgcccccgtgggcatgggcggagcgggcgagacctacaacatcaacgccgacaccgccgccggcgccatcgccggggccaccaacgccaagcgcctgctgatgctgaccgacgtggccggcgtgctggacaagtcgggcaatctgatcccggaaatgaccgccgcccaggtccatgcctatatcgccgacggcaccatttccggcggtatgattcgcccactgcagtatctcgctctgatctatcacattcgcggcgttcacggtgctgtcactgctgggcgcgcgactgccgcaccgccattctggttgctcgcttcacccttcgtgctgtgagttcgtgttgattcagccctggtttagagggccctctacgcggccttggcctcggatccacccattcggaggcacagcctccccaaccctccagtttcttatgaataaatatcctggaggctcggaggctgtgcctccgaatgggtccgggcgatagcccggccgcgtagcgggctccctaaacactgcccagcagcacgaatttcagcacgaaggcccccgccagcagccacaccgccgggccgacgtcgcgcgccttgccgcccagcagcttgaccgccgcgaaggtgataaaccccagcgaaatgccgtgggcgatggagaaggtgaacggcatggccagggcggtgaccaccgccgggaccgcctcggtgacgtcgtcccaggcgatgtcggccagggagcgggccatcaggcaggccacgaacagcagggccggcgccgtggcataggccggaatggctgccgccaggggggccagaaacagggcggcggcgaacagcaggccggtgaccaccgccgccaacccggtgcggccgccggcattgatgcccgaggcgctttcgatatagctggtggtggtggaggtccccaacgcaccaccggccatggccgccagggaatcggcgatcagggcgcggcccagccgcggcagcctgccccgcgcgtccagcatgcccgcccggtgggccagaccaatcagtgttccggcattgtcgaacagatcgacgaacagcagggcgaagacgatggttactagccccaggttcaaggctccggccacgtccatcttgagaaaggtgggcgccagcgacggcggccaggcggcgatgccgccgaacggcgtgacccccagggccatgccggccgccgccgtgcccaggatgccgatcatgatggcacccggcacccggcgggcctccagcccgaccatcgccacgaagcccgccgccgccagcagcggctccggccggccgagatggccgagcgtcaccagggtggccttgtgcccctcgaccagcccggcgctttcgaaggcgatcaggccgaggaacaggccgattcccgccgaaatggccagcttcagcgattgcggcacggcgttgatgatggcctcgcgcacccgggtcagcgccagaaccaggaacagcacgccggagacgaacaccgcccccagggcaaccggccagggcacgcccatgccgatgaccacgccataggtgaaataggcgttgagccccatgccgggagccagggcgatgggataattggccagcagccccatggcggcgctgcccagggccgccgccaggcaggtggcgacgaataccgcgcccttgtccatgcccgcctcggccagcatggccgggttgacgaagatgatataggccatggtcaggaaggtggtggcgcccgccagacactcggtgcgcaggctggtccggtggccggacagatcgaacagacgctgcaacatggccccagcccccttttcaaggaatccgcatcatccttgaccctcatcatggatgcgtgcggcgataaagttgtatttttttcccgcttttcgaaggcgtcatccggaggacccatgccccgtcgcttcatccatcgccatcaatcgcgtcaatgcctgccgtcgtggacgaaagcggggctgggcgtggtgctggcgctgggggtggtggcctggatggaccaggcgggcggcgcccccttgctggcggcgcccctgggagcgtcggcggttctggtgttcggcatgccggactcgcccctgtcgcagccgtccagcgtcatcggcagccatctgatcgccaccaccatcggcttgctgttcgatcagttcctgccgggcggctggatcagcatggcgctgtcggtggcgttggtgatggtggtgctggccggcctgcgcctgacccatccgccggcgggtgcggacccgctggtggtgatgatgggccatcccgggtggggattcctgctgctgccggtcctggcgggggcggtgaccctggtggcggtggcggtgctgattcaccgcctgccaccccgggcgacgtatccgctgcccatccggagtccggcgggcggcggctgaggcctactcttcctcgccgccccggtcggaaagagccttggccagatcatagatgcgacggcgcacgtcggggtcgacgatgctgtagtaattgcgcaccagttccagcgtctcgcggcgcaggcgggggtcggcctcggcggccggcggctcctccttgggaggctcgcgcaccatctgcaccggcgacaggcccttggtctcctcgggcatgtcgtcgaagaagtatgagatcggtacttcaagcgaccgggacaaatcgaacagtcgcgagcaactgattcgattggcgccgcgttcgtatttctgcacctgctggaaggtaagtcctatcaactcgccaagcttttcctggctgagccccagtaacgtccgccgcaaacgcatgcgcgatccgacatggacatcgatcggattaggcgccccggctggggtacggcctcgatttgcctttctgcgcggcatgtttccctctgtcacatgaagcgcccaatacttgctctagtaactttacaaacgcaagagggaaagatcgcccgaaataatagaaaaaccaacaatttaggctagcacacacaaacccggactcaaactctatctattagacaaccgtttggaggtaactctgctgaagcaacccaaagcacgtcaccaaaatccccctcccacggcccgatttcgattgatacggttactgtatgccttaaggttaggtctgtcggctatttgctttgggtcgctggaattcaatccaacaggaagacttgaaatcaatccaattggaaaacttgggctttaagataggcactctcgggcagccagggatggaccgggtggtccgacgcggcgccggcactgcgcaggatgcggccggaccgtcccgccagatgcagcccatggccgatttcctcggcgaaggtttccaccggcatgtggtgggagcaagacgcgcacagcaggaagccgcccggctcgaccagggcggcggccaagcgggccatcttgcggtagcccttggccccggcgcccagatccttgcgcgacttgacgaaggccggcggatcggccaccaccagcccgaaacgctctcccgccagggccaggcgctccatctcggcgaaggcctcggcccgcaccgtctggacctcgaccccgttgagccgtgccgcctgatcggccagggccagggaatgttccgaccggtccacggcgatggtttgggtggcgccggccttggccgcctgcaccgcgaagccgccggcataggtatagaggtccagcacgcgccgccccttggccagacgggccacgaaggcgcggttgtcgcgctggtcgaagaaccagccggttttctgtccgccggtcagatcggcgacgaagcggcacccgttctcctccagctccaccgggccgtccacctgcccgaaggccacgtcgtgatggggctcgagcccttccagcttgcgcaccgggctgtcgttgaccagcaccacggcgcggggggcgagaaccatctgcaaggcgtcgagcagaacgggaagcaggcgctccatgccggcggtgttagtctgcaccgccagcacgtcgccgtagcggtcgacgatcaggccgggcaggcgatcggcctcggaatggacgaggcggtaatggggggtgggaaacaacgtgtcgcggagcgccagagcggcgcgcaggcgttcggccaggaaatccacgtccacggtgtcggcggcgcggcgcgacagcacgcgggcggcgatcagggaatgggggttgaaggtggcgacgcccagacgctcgtccccggcatccatcagggtgacgagagagccgggcggcagggccttggcctcggcccccatctcgatctcattggagaagacccagggatgaccggcccgaaggcgcttcgagcgccccttggccaggcggatcacgggacgggcggcgggctggtctggatgtgtctgtgtcatggccggcactttacggcggggaatcattatcgccaagggcctgaaacgcctgaaaatcgccatactttgatatatgtcaatggcggcccgtgcttccgtcggcatagtgcgcacacttgaagcaaagaaccacccggccgccatcggccccgggggcatggtgtcgccatggatccggccggatgcttcaggtggacccttttccggtcgaaacaggagttcggcatgagcatcaacactgaagccacgccctatcgcgacgacgtgatcaagaagttcacgatcgccgcgattttctggggcgtcgtgggcttcctggcgggcgacttcatcgccctgcagttggcctttcccgttctgaacctcgatctcgagtggacttcgttcgggcgcctgcgtcccgttcatacttccgcggtgatctttgcgttcggcggtaacgttcttttctccacctctctgtacatcgtgcagcggacctgccgtgccagcctgttcggcggttccggccttggtggtttcattttctggaatttccaggcgctgatcgtcgtcgccgctctgtcctatgttctgggcttcagccagggccaggaatacgcggagccggaatggtggatcgacctgtggctcaccgtgatttgggtggcctacctgatcgccttcgccggcaccatcatgaagcgtaaggaaccccacatctatgtggccaactggttcttcttcgccatgatcctgaccatcgccatgctgcacctcggcaacaacatcgcggttccggccgccctgttcggcggcagctggatgaagagctacaacgtgttcggtggcgtgcagaacgccatgacccagtggtggtacggccacaatgcggtgggcttcttcctgaccgccggcttcctcggcatcatgtactacttcgtgccgaagcgggccgagcgtccggtgtactcctaccgtctgtcgatcgtgcacttctgggcgctgatcttcctgtacatctgggccggtccgcaccacctgcactacaccgctctgcccgattgggcgcagaccctgggcatgaccttctcggtgatgctgtggatgccctcttggggcggcatgatcaacggcctgatgaccctgtcgggtgcctgggacaagctgcggaccgatccggtcatgcgtttcctggtctcctcggtggcgttctacggcatgtcgaccttcgaaggtccgatgatgtcgatcaaggcggtgaactcgctgtcgcactacaccgactggggtattggccacgtgcactccggtgctctgggctgggtcgccttcgtttccttcggcgctctgtactacctggttcccaagctgtggggccgcaaggagctgtactcgctgaagctggtgggggtccatttctgggtcgctaccgtgggtatcgtcttctacatcaccgccatgtggatctccggcatcatgcagggcctcatgtggcgtgcgtatgacagcctcggtttcctgcagtactcgttcatcgagactgttgaggccatgcgtccgtactacatgatccgtgctctgggcggcttcctcttcgtgctcggctcgctggtgatggtctacaacgtcttcaagaccatcaagggcgacgtcgctgcggatgaggcggttgcttccaccgccggcgcggctcgctgaggagacccgacccatgttcaagcatcacgctaagctcgaaaccaacatcttcttcctggccgtcggcatccttctcacgatcgttgtcggtggtctggtcgaagtcgtgccgctgttctcgatcgaatcgacgatcgagaaggtggatggcgtccgtccctattctcccctggagcagaagggccgcgacatctatatccgcgaaggctgctacaactgccacagccagatgatccgtccgttcaaggacgaggtcgaacgctatggccattacagcctcgcggccgagtccaagtacgatcaccccttccagtggggctcgaagcgtaccggtcccgacctggcccgcgtgggtggcaagtacaccgacgactggcaggttcgccacctcatcaacccgcgtgacgtggtccccggatccatcatgccgggctacaagcatctggctcgtccgctggactactccgacatccaggccaacatgaaggccctcaaggttgtcggcgtgccctacacggacgcgcagatcgccaatgccaagaaggacctggaagagcaggttttcggcgacccgtctgccaagacggccgtcggcgccagctatcccaaggccaagatcggctcggcgtcgggtaacgccaaggtcaccgaaatggacgccttggtcgcctatctgcaggtgctgggaaccatggtcgatttctcgaccgtgaagcccgaggcaatccgccgctagaggagtacggggtttgttcgtcgctttcgtcgacaatatactccggcccttctgggtcttgtgggtgatgatgatcttcaccggggttgttttctatgcctactggccgaagaacaaaagtcggctggaagactacggaaacatcccgttgagggacgacaatgaggagcgctaacaatggcgaccattgaaaaggactcggtgtccggtcagaacactaccggtcacgagtgggacggcatcaaggagctgaatactcctttgccgaagtggtgggtctacgttttctgggccaccgtcctgtgggccatcggctactgggtcgcgtacccggcgtggccgctggtcaacggctacaccaagggcacgctgggctattcgtcccgcggcgagctcgataacgaactggcggcccagaagaagtcccgttcggcttggctgtccaagatcgaggcgtccgacgtggccgccatcgagaaggacaaggacctgctgcgctatgccatggccggcggcaagatcgcgttcaacgagaactgcggcgcttgccacggtgtcggcggcgtcggtgcctatggctacccgaccctggccgatgacgaatggctgtggggcggcaccctggccgacatcgaacagaccatcaagttcggtgtccgcaacaccaacgccaactcgcgtcagagcgagatgccgaagtttggtgtcgatggcgtgctcaagcccgagcagatcgccgccgtctccgactacgtggtgtcgctggcctccaaggctccggccaagggctcggcgggcgagaccgtctatgccgaaaactgcgccgtctgccacgccgaagatggttcgggcatggccgcggtgggtgctccggccctgaacaaccagatctggctgtacaagggcaccaaggacgccatcgttgcccaggtgaacaagcccaagcacggctccatgcccgcttggtccgaacgcctggacgccagcaccatcaagatgctggccgtctacgtccataacctgggcggcggcaagtaagagtgtaagtggggggacccggtggggtgcgtgcctggaaacaggggcgcaccccatcggcatatctggaggctgctcatcgccccgttccgccgccggccggacccgcgccgcgctgggcacgggcgataaaacaagcattctagattcgatgaatttggagtatcacaaccgcgtggcgggacggggcgcgaaacacgcctccccgccttgtcatttggccccccttcgcagcagagcgttcgcacatcatggcctcccccaagatcgatccgaccctgaagaagcccgccggcgacggcgacggtccgctttacgccgagaccgtgatgattcacccgcgcacggtgaaggggattttccgtacctggaaatgggcggccatgatcgtcctgctggcggtctatcacatcgcgccgttcctgcgctgggatcgcggtcccgatgcccccagccaggccattctggccgacatgaccggtcggcgcggctatttcttcttcctcgagatctggccgcaggaggtctactacatcaccggcctgctgttcctggccgccatcgccctgttcttcatgagctcgctggccgggcgcatctggtgcggcttcttctgcttccagaccgtctacaccgacctgttcatgtatgtggaacggctggtggtgggcgaccgcgccaagcgcatggcgctggaccgcgccaaatggaacggtgaaaagctggtcaagaagaccatcatcaacgtggtctggctgttgatcgccgcctcgtgcggcatcggcttcaccctgtatttcggcgatgcgccgaccatgctgcgcgacatcttcgccggccgcgaggatactgcggtctatggcaccatcgccgtggtgggcggctgctgcttcctgctggccggctatgcccgcgagcaggtctgcctgtatatgtgcccctattcgcgcttccagtcggccatgttcgacgagcattcgctgatcatcacctatgaggaatggcgcggcgagcccaggaagcccatccgcaagagcgagaccttcgaaggccggggccactgcatcgactgcaagatgtgcgtcaccgcctgccccaccggcatcgacatccgcgacggcatgcagatgggctgcatcggctgcgccctgtgcatcgatgcctgcaacaccatgatggacaagtacaacctgccgcgtggcctgatcacctgggattcctcggccaatctcgcggcgcgggaaaagggcgagaagaccagcatcaagctgatccgtccccgcaccatcgtctacgtggcgatcatcaccgcggtcagcgccctgatggtcttcggcctgtcgtcgcgcaagagcttcgacatcgccgtgcagcacgagcgcgccccgctgttcgtccagttgtccgacggcgcgatccgcaacggctataccgtcaagatcctcaacatggtgcgcgagaaccgcgagttcgaactatcggtgtcgggcatcgacggcgccggcctcagcgtggtcggcggccaggcctcgggcgccaaggccatgctgcgggtcgaacccgacgcggtcggcacctacaatatcttcgtcaccgctcccgccgacaagttgcagggcaagcgcacgccgctgtactttaccctgcgcgagacggccaagggcggaagcaaccgtctcgaatccctgttcgccgcaccggagaggtaatatggacatgacccaacagcgcaagcccggctggtggtacccctatatcttcgtcggcggcttcatggtggtgctggcggtgaacttcaccatggcgtatttcgccaattccaccttctcggggatctccaccgagcgtccctatgaaaagggtctggccttcaaccagaccctggaggccgcccgcaagcaggaggccctgaactggtcggtggacctgcaggtggagcccgccgccaaccatggcgcccatgtcaccatcacctacaaggacgcggcgggccatcccgtggacggcatggaggtgaaggccctgttcgtgcgccccaccgccaagggccatgaccgcgaggtgcgtctggccccggtcggtcccggcgcctatgccaccttgcaggaactgcccctgtccggcgtctgggacatgaccctgctggcttcggccaaggatacgccctattcggtgctgcgccgcatcgtggtgccgtgacccaggctgtgttgtgccgccattgcggaggtcccatgccggccgatctggccggcgacttctgctgtcgcggctgcgagggcgcgtttcacctgctcgaaggcctgggcctggagcagtactacagccgccggaccaacgatccggcggcgcggctgttgcgccccgacgacgatgccgaccgctatcacgacttttccgcccatgtcatcaccgacggcgacaagggtgaatccagcctccatctgatgatcgaggggctgcattgcggcgcctgcatctggctgatcgaatctctgctgaacaagcagacgggcgtcacctgggcgcgggtcaacatgaccacgcgccgtctggtggtgcgctggcacaccggcgagaccgagccaggcgtcctgctggccccggtgatcagcgtcggctaccgtctggtgccctacgaccccgagcgcctcggcctggaaacccagcgccaggaaaaggaattgctgcgcgccatggccatcgccggcttcgccgccggcaacgtcatgctgctgtcggtctcggtctgggccgggcatttctcctatatgggacccgccacccggggcctgatgcactggatctcggccctggtggtcctgcccgccgtggcgtggtgcgtgcgccccttcgcccgctcggcggtggcggcgctgcgggccgggcgcaccaacatggatgtgcccatcaccatcggcgtgaccctggcctgcctgatgagcctgtgggagaccatcaatggcggcgaatacgcctatttcgattccgccatcactctgctgttcttcctgctgatcggccgctacctggattcccgggcgcggggccgggcccgaaccacggtggagcacctgctggcgctggacgccgtggcggtcaccgtgctggaagacgacggcagccagcgcatgctgcccccccacaaggtggcgccgggctcacgcgtgctggtggcggcgggcgagcgcatcggcgtcgacggccgcatcatcgacggccgctcggacgtggataccagcctgctgacaggcgaaagtctgccggtctcggtcaccgccggagcccaggtcttcgccggcaccatcaacctgtccgccccgctgcgcctggaagtgtcggcggtgggcgagcgcaccctgttggccgagatcgtccgcatgatggaggtggccgaacagggccgcgcccgttatgtggccctggccgaccgggtgtcgcgctggtacgccccggtagtgcacgtggctgccctggccaccttcaccggctggaccgtcttcaccaatacgccgtggcaggaggccctgctttatgccgtggcggtgctgatcatcacctgcccctgcgccctggctctggccgtgccggtggtgcaggtcatcgcctcgggccgcctgatgcgccagggcgtgctggtcaagtcggccacggcgctggaacgcttcgccgatgccgacaccgtggtgttcgacaagaccggcaccctgaccctgggcaagcccagcctgaccgaggacggcggctggacccgggacgacctgacggcggcggccgggctgacgcccgcctcgcgtcatcccctggcccgggccatcaccgccgcctgtcctactgccccggtggccgacggcgtggtcgaggttcccggcatgggactggagattcccgcccaaggcatccgcctgggcagccgtaaattcgtcggcgtcgccgacgacgccagcggcgacggccccgagctgtggctggcccggcccggccatgcgccggtgcgctttgccttctccgacgccttgcgcgccgatgccgttgccgtggtggccgagctgcgccgcctgggcatatccgtcgaactgctgtcgggcgatcgccccgccgccgccgccaaggtggccgaagccctgggactggccgagtggcgggccggatgcacgcctgcggaaaagtgcgcccgtctggccgagctggccgggcaaggccgcaaggtgctgatgatcggcgacggcctcaacgacgccccggccctggccgccgcccatgtctccatgtcgccgtccaccgccgtcgacgtcagccagaccgccgccgacgtagtgttccagggcgggcgcctcgcccccgtcatcgagaccctggacgtggcccgcctgtcgcgcatcctggtgaagcagaattttggtctggcgctgggctacaacctcttcaccgtgccgctggccatagccggaatggtcacccccctcatcgccgcgattgccatgtccacctcgtcactggtagtaattggaaacgccctgcgtctatcgcgccggagaggttagtggacaatctgttgatgctgattcccgtggccctgggtttgggcttcgtggggttgctcggattcctgtgggctttgaagtcaggtcagttcgatgaccttgacggcgcggcgcatcgcattctctttgatgacgacgaacagcccaagaccggggcttgagggggatgggtagcctgcacatgccgcccctcgactacgacgcccagaagactccgcacatcgccgatctgcgctcgccccagtgccgcaattgcgacatcgtgcgcgaggtggccttttgcgccgacctctcccaggacgaggtcaagcggctggccacggtacgctgccacgcggcgcttcccgccaacttcacggtgttccgcgagggcgacgaggtcgaccacgtctattccatctccaacggcgcggtgaagctctacaagctgatgcccgacggacggcgccagatcatcggcttcctgttttcgggcgatctgttcggactgggcatcgacggcggttattgctacaccgccgagaccatcacgccgacccatctgtgccgcttcacccatcgcaagctggacagcctgatcagcgagattccccgtcttgagcgccgcatgttcaccatggcggtcaaagacctggtctcggcccaggaccagatgctgctgctgggccgcaagacggcgcgcgagaaggtcgccaccttcctgctgcgcctgtcgcagcgctcggcccagatgggccagccgtccagcccggtggcgctgcccatgagccgcgccgacatcgccgactatctcggcctgaccatcgagacggtcagccgcaccttcacccagctcaagcgcgacggcatcatcggcctgccggcctcgggtcattgcatcctcaatgacccggacgcgctgcgcgagctggccgaaggcacctgaagccgcaaccgtccattaccgtcccaaagcgaaagaggccctccggtgagcaccgaagtcaggatcaaacgcatcaccacgcgcgacatccgcgcccgcaagggggccgagcccctggtggtgctgaccgcctatacggctcccatcgcccgtctgctcgaccctatctgcgacatcctgctggtgggtgactcgctgggcatggtggtctatggcatggagaccaccctggccgtcaccctggagatgatgatcaatcacggcgccgccgtggtgcgctcgtcgtccagggcctgcgtggtggtcgacatgccgttcggcagctatcaggaaagcaaggaacaggcgttccgcaactgcgcccgggtgatggccgagaccggctgtgccgccgtcaagctggagggcgggcgcgaactggccgagaccatccgcttcctgaccgatcgcggcatccccgtgatggcccatatcggcctcaagccccaggccgtgcacgccgccggcggcttccgcgcccagggccgcatcgagtccgaggccgaggccattcgcgccgacgcccgcgccatcaccgaggccggcgccttctccgtggtggtcgagggcaccgtcgagccggtggctcaggcgctctccgccgagatcgccattcccaccatcggcatcggcgcctcggccgcctgcgacggccaggtgctggtcatcgacgacctggtggggctgttcgacgacttcaccccgaaattcgtcaagcgctatgccgatctgcggccgatcatcaccaaggcggccgaggattacgccgccgaggtcaaggcccgcaccttccccggtcccgaacactgctttggggtggcgaagaagtgagcaccgccgtccacatcgtccgctccgtcgcggcgttgcgcgcccaggtcggcgcttggcgcgacgagggtctgtccgtggcgctggtccccaccatgggggcgctgcacgccggtcacctctcgctggtcaagcggggcctggaactggccgaccgggccgtcgcctcggtgttcgtcaaccctacccagttcggccccaacgaggacttcgcccgctatccccgccaggaagagctggacgccgccgccctgagttcggccggctgccacctgctgttcgcccccgacgtggccgagatgtaccccgaaggcttcgccaccacggtctcggtcagcggcgtctcggacgggctgtgcggcgcggtgcggcccggccatttcgccggtgtcgccacggtggtgaccaagctgctgctgcaatgcctgcccgacgtggcgctgttcggcgagaaggactatcagcaactggcggtgatccgtcgcttcgcccgcgatctcgacattccggtccgcatcgagggcgtgcccaccctgcgcgaggacgacggcttggccatgtcgtcgcgcaacgcctatatgacgcccgagcagcgggccatcgcgccctggctgatccgggcactgaccggtatcgccgatggcctgcgggccggggccaaggccgccgatctctgccccatggcggtgtcgggcctgctcaaggccgggttcgattcggtggattacatcgaggtgcgcgacgcggcgtcgctggcgccggccgagatcctggaccggcccttgcgcatcctggccgccgcccgcctgggcaagacgcggctgatcgacaatatcggggtggaaccctagacctgggctatcgcccagacccatttggggcgatgccccaagcccccttttcattctcaaaatgaagggaggtttggaggcatcgcctccaaccggggaccggggcgggagccccgcgtgacgtcctaccgccccgccaccatcagcccgtcgatgcgcagggtcggcgagtcgatgccatggcgcagcgtcagatcattggccggggtaaggttgaggaacatctccttgagattgcccgccaccgtcacttcgttgacggcgaaggccaactcgcctcccttgatccagaagcccgaggccccgcgcgagtaatcgccggtgacgccgttgaccccctggcccgacagatcagtgatgtagaagccttcggagatgtcgtggatcatctcggacggcgtgatgtggccggcttccagatagaaattgctggccgagggcgagggtggcgacgaggtaccccggctggcatggccggtggaccgcatccccagctgccgggccgagcgcaggtccagcagccaagtggtgagcacgccgtcctcgacgatggcgcggggctgggtggcgatgccctcgccgtcgcaggggcgcgagcgcaggccgcggcggcggtggggatcatccatgatgcggatgccgcgggggaagatggcctgacccagcttgtccttgaggaagctggtgccgcgtgccacccccgagccattgatggcacccgccaagctggacaccaggccacgcgccacccgcgggtcgaagatcaccggcacctgcttggtggccaccttgcgggcgcccaggcgatgaacggcgcggcgcccggcctcgtggccgatctcctccggcgcacgcagatcggccaggaacaccgccgaggaataatcgtagtcgcgctccatgccctgcgcattggtgccggccagcaccgataccgacagcgacgacgaggtcaccgaataggcatgggaaaagccattggaggcgacgatggccacgcccgaccgcccccagcccgcctcggcgccctcggaattggtgacgccgttcacggaacgggcagcgtcctcggcactgcggaccatgtcgatcaactgttccgccgagggctcgtgcgggtcacagacatccagatcgggaaaggacgtggccagttcaccgggctcggccaagccgcaataggggtcctcggggatcgagcgggccatggccacggcgcgctccaccaattggcccagggccgccttggaacggtccgacgaggacacgaaggcctgatgcttgccgatcagcacgcgcagccccacgtcgccggattcggcccgctccaggcgctccagcgcgcccaggcgcatgcccacggacagcgaggcggaatcgatcagcaccgcgtcggcggcttcggcgccggccttgcgggcatcggcgaccagatcactcagcagatcgaggggcaaaatcccgggcatggcggcggctccaacaggggagcgttcaggctgccccgattcgcggccgccgtaaaggggggatcacggcagggggctcagtccgatcaccatggggtgcagccacagcagcacgggatagagggccaacccgccgcagatgcgcgcccagcccagttcagccagcagggcgcggggctcgaacaccgcccgttccgccatctcgcgccagtgccggtcgcccagggacttgcggcgcttggcgtcgagaatgcgcggccccaccaggcacagcagcagcagcggcacgaacagcagcagcccggccagatggccgttgggcaggatatgggcggcgctccacagacccaggccccagatgatgggatgacgggtcaggcgcacgatacccggccgcgccgggtcatagcccgcccctcccgggccgatggagaagggattcttctgggacaggcccagcatccagaacaggcaggccaccggcatgaccagcggcggcacccagcgcatccagggctgttgctcccacaccaccacggtgggggaattcagcgcggcggcgattacccagaccagcaggattgtggagaccacggaatagccggcatagaagcccgccttgccatagcgggcctcgatggggccgcgcagcggcttccagttggacagcgaatgcgcccccaggaacgccgccaccgacaaaaccagatggccgacgccgccggtgaaagtcattgccggcccaccctcgccgaacactcgccgccgcgatggccggcgagcacgattcgaaggggtcgaatcatgctctagaactccacctcgggcagtttgtgcaggcgggcacaagccaccagggtgttgcgaagcaggcaggcgatggtcatgggaccgacgccgccgggcaccggcgtgatggcccccgccaccttgaccgccgaggcgaagtccacgtcgcccaccagcttcttggtgccgtcgggcagctcgatgcggttgatgcccacatcgatgaccgtggcgcccggcttaatccagtcgcccttgatcatctccggccgccccaccgcggcgatgacgatgtcggcgcgacgcaccacgccgggcaggtccttggtctgggaatgggcgacggtgaccgtgcagctttccttgatcagcaattgggccatgggcttgccgacgatgttggagcggccgatgaccacggcgtccaggccccccagcttgcccagcgtgtccttgagcagcagcagcgagcccagcggcgtgcagggcaccagcgcatcgccgccggcggccagacggcccacattgacgggatggaagccgtccacgtccttggccgggtcgatggcctcgatcaccttctgggtatcgatgtgcttgggcaccggcaactgcaccaggatgccgtgcacctcggggtccttattcaggctctcgatcagcagcagcagtgcgtcctcgggggtgtcggcgggcagcttgtgctcgaacgagcgcatgccggtctcgacggtgcgcttgcccttggtgcgcacatagacctggctggccgggtcctcgcccaccagcaccaccgccaagccgggggtgatgtgatgggccgccttcatctcggccacgcgggccgtgatggtctcgcgcagtttggcggaaaacaggttgccgtcgatcagcttcgcgtcagtcatggttgcttgccatccactcgtcgaggcgatgccgcaaatcctcggtctcgccggaaatcaagatcaccttgcgccggtcggtggcgcccaggacgatatccatgtcggacttggggattttccaagccttggacaaaagcttcagcagcgccgcgttggccttgccgtcctccggcaccgccgtcacctgcgccttcaacaccaccgccccgtccgcctcggccgccgggccgttgatccggtcgcgggacgccttgggggtgagccggacagccaccttcagcccgccggcacagggggcgaagggcgaagcgctcatgacatcatgacgagcctgagcgccttgcccagcagcatctccacgaacaggatgatcagccagagcacgatgggtgaaagatccaccgacccgaggtcgggcatcatccggcggatcggccgcagggccggctcggtcaggcgatagatgacgtccagaatggtccgcaccgtggaattgtaggtgttgatcaccccgaaggcgaccagccaactggcgatcaccgatgcgatcacgatgtacatgtacagatcgagggcgatgaggatcaccctgatcagcggttccagaatgaagtccatcggcggcacctgtgagggcatttcgaatcgcgcccaaacctatcctcggcggccttgccgcgcaaggctgccgatgccatctttgaaggcacctaatccagggagggatggtaatggacgacgacgtcaagagtctcagccccaagatcgacatgacccggcgcggcttcgtgtcggcggccgtgctggccaccggctacgccctggcggtcagcccggccagtgccggggccatcaccaccgattcccaggggctttccgccggggcggtgatgatccccaccccaggcggtcatccgctgccggcctatgccgccatgccggcgggcaagggtcccttccccatcatcttggtgattcaggagatcttcggcgtccacgagcatatccgcgacgtctgccgccgttttgccaagctgggctatctggccgtcgcgcccgagctttatttccgccagggcgatcccgccgtgctgaccgatatccccaccatcttgtcgaccattgtcgccaaggtgcccgattcccaggtgctgtccgatctggatgccgccgccgcctgggcggcagccaatggcggcgacggcgaccggctgggagtcaccggattttgctggggcggccgtgccgtctggctgtattccgcccataatcccaaactgaaggcggcggtggcctggtacggcaagctggtaggcgccccgtccgccgaaacgccgaagcatcccgtcgacatcgccgccgatctgcatgcgccggtgctgggcctttacggcggcgccgatcagggcattccgctcgattctatcgagaagatgaaggcggcgaccaagccggcgcgggtcaaggtggagttcgtggtctatcccgacacgccccacgccttccatgccgattaccgcccctcgtaccgcgagggaccggccaaggacggctgggccaaggctctggcctggttcaagaccaacggcgtgggctgaccgggttaaccctgctcgcccacggggcgcgtcagggtccgcaacgtcgcttccaaccccgtggccagggcttcctgcgcctcgggggattgggcggcgatggcggcagcgatggcgcccagaggatcgccctgcagtaattcatggcccgacgaggtcagctccagccggttgcggcggcgatcgcccagttcgggcaggcgctcgaccagacccttgcggaccagggcggccacagtctggctggcggtgccgctggtggtggcgtggtaatgggcgaaggcggtgacggtacgagcctcgggcaccgcctcggccagatagcgcagggcgctccactgggccggattcagccccccgacaaacgccgccccgttggccagccgcagaatctgcgccatggcctcggctgcgacccgggctgaaaatcgaaacctagcgttaccatccatcatatttcatcatcgcacggggatttgtgcgacgcaacggaccgcgagcctattcgctgccaatccgctcgatacagccttttgacataaggaataatacgtcctggggcgaatcgccgcgcatggccagatcggggtcgagccgcgagtaaagcccgcgcagcacccgtccggcgatgccgtggctgaccgcgatcaccttgtcgccgggcgccagatccgccagccagtgggccagccggctggccacgtcgtgatggctttcgccgccgggacagcggaacacccagtggtccagtccctcgccctccagcatgccgggatggcgcgccgccagttcggccttgggcaggcccgaccactggccggtatgaacctcgcgcaggcgatcatcaaaagtgatggagcggaaatccagctcggcgacttcgcacaggattccggtggtctgggcgcagcggcccagcgggctggacaccacccgccagcccccggcatcgcccagcatctggcgcagcttgcggccataggcccgcgcctgggccgcgcccttgggggtcagcggcgaatcgccgtgaccctggacgcggccctcgcggttccagacagtctcgccgtggcggaccaggatgacggtcggcacggcctgggatcagccccgaagctcgccgccggtggccttggccaccgccgcgacgatcttcgcccccaccgcctcgatgtcctcgtcggtcagggtcttgtcggtgggctgcagcgtcacggtgatggccagggacttcttgcccgccgccatcttgtcgccctcgtagaggtcgaacaccgccacgtcgctgatcagaaccttgtcggcattgcgggcggcccgcaccaccgcatccgccgccacgcccgtatccagggtgaaggcgaagtcgcggtccaggggctgcaaggccgaggccttgagcagcggcttggccttggtggccttggccttctgcgccggcagggcctccaggaacagctcgaagccggccaccggacccttgacgtccagcttggccagaaggccggggtggatctcgccgaagaagcccaccggcttgttgcccagcttgagcgtgcccgagcggccggggtggtaccagacgggcgcctcggcaaccacctgcagcgagtcgggattggccccggcggccgccacggcggacaggatgtcggccttggcgtcgaaagcatccacggcgcgggccggatcggcccagtgacggccgcgcgccctgccggctcgaatgccggccgccaccagacgctgctgccccggctcgggtccgtcgaattgcggccccagttcgaacaggcccaggtccttcatgccgcgatcggcattgcgcccggccgccgtcaccagattgggcagcaccgagggacgcatcacgtcgagatcggacgagatgggattggccaagtgcatttccggggcgccgccgccgaacatcacggcctgggcctcgggcaggaacgaccaggtgaccgtttccaccagcccacgggtggccaactggcggcgcacccagccggaacggcgctggccgggggtcagcaccggcttgggcatggccggacgcggcatgggagtggcggggatgttgtcatagccgttgatgcggatgacctcttccaccagatcgtgctcggcggtgatgtcgccgcgccatgacggcggattgaccagcaggccgtccgcatgctcggccacggcgcagcccaggtcgttgaggatggtctccatgcgctgggtcgacacctcgacgccgcccagttcggcgacgcgattggggcgcagcacgatggatttctgccaatcgggctcggtgccggcgatcaccgcctccgaggcctcgccgccgcacagatcgaggatcatgcgggtggccagctccatggacggcaccacgaaggccggatcgacgccgcgctcgaagcggaagcgggcgtccgacaggatatccagcttgcgcccggtggcggcggtacggatggggtcgaaataggcggcttccaggaacacctcggtggtggcctcggtgcagccggaatgctcgccgcccaggatgccggccagggcctcgggtccgttctcgtcagcgatgaccgtcatgccggactccagcgtgtaggtcttgccgttgagaccggccagggtctcgccgtcacgggccagacgggcgcggatgtcgcccttgaccttggcggcgtcgaagacgtgcagcgggcggcacaggtcgtaggcgaagaaattggtgatgtccaccagggccgagatggggcgaagcccgatggcggtcaggcggtccttcagccattgcgggctgtcgccgttcttgacgccccggatcaggcggccggcgaacagcgggcaagcgttggagtcctcgggcgcgaactccaggcgcacgccgatggagcttttgaaggcgccgggcaccggctcgaccttcaggggcttgaggttgcccagaccgaaggccgccagatcgcgggcgatgccgcgcacgcccaggcaatcgacgcggttgggagtgaccgagatctcgatcatgggatcgaagctcatgatgtcgagcaggctggcgcccaccgcaagggtgacatccagctcggcgatgccgtcgtggtcctcgcccagcttgagttcgcgccacgagcacatcatgccctggctttccacgccgcggaccttgcccttcttcaggacgtcgccggtgatggggatgtaggtgcccggctgggccaggatgactttcagcccggcgcgcgcattgggggcgccgcacaccacttgaagaatccctgcgccgctgtccaccttgcacagcttcagcttgtcggcatccggatgcttctcggcttccaggatatggccgaccacgaagccgcccagatgcttggacgggtcgtcgatgccctcgacctccaggccgatggcggtcagacccacctcgatctgttccagggtcgcgtcggtgtccagatggcttttcagccaatcaagggtgaacttcatcgggtcagccctcccgaaagcgtgggaacgtccagcggcacaaagccgtaatgcttcagccagcgcagatcggaatcaaagaaggtgcgcaggtcgggaatgccgtatttcagcatggccatgcgctcgacgcccatgccgaaggcgaagccctggtagcggtcggggtcgatgccgcagttgcgcagcacattgggatggaccatgcccgagccgccgatttccagccagccggcgccgggtccgatcttcagttcgccgccttcgcgcgaacagccgatatccacctcggccgagggctcggtgaaggggaagaagctggggcggaagcgcaccggcacgtcgtccacctcaaagaaggcgcggacgaattccagcaggcagcccttgagatggcccatatgggtgatctcgtcgatgaccaggccctcgatctgatggaacatgggcgtgtgggtcatatccgaatcgcagcgataggtacggcccggggcgatgatgcggatcggcggcttgttggccagcatggtgcggatctgcaccgggctggtatgggtgcgcagcagatggcgccccccgtcgggcttctcgccgaaatagaaggtgtcgtgcatctgccgcgccggatgctcgggcggaatgttcagcgcgttgaaattgtggaaatcgtcctcgatgtccgggccttccgccacatcgaagcccatctgggcgaagatggcgctcatctcgtccatgacctgggaaatggggtgaatacgccccagggattcgggccgcgacggcagggtgacgtcgatgcgttcacgggccagacgctcgtccaggccttggcctccagcgtcgccttggcagcggccagtgcgccctcgacctcgccccgcgccgcgttcagcgccgcaccagcggccttgcgctcgtcggggcccatgccgcccaggctcttcatcaggccggtaatggtgcccttcttgcccagcgcggcgacgcgggcggcttccagctggtccagagtcgtggcggcggccacggcggccaaagcttcggactggagtttatcgaggtcctgcatctctctcgttccccaagacgcgaaaaggggccgccccattcgggtcggcccctctccaacacaatgcttcccgacgggaagtcctactggagggcggcctgagccttttccaccagcgacttaaacgcatcgggctcgcggatggcgatgtcggacagcaccttgcggtcgagcgcgatgccggccttcttcaagccgtccataaaacgcgaatacggcaggccgtaggcgcgcgaaccggcgttgatacgctggatccacagggcgcggaagttgcgcttcttggcgcgacggtcgcgataggcataacgcagagccttttcgaccttctggatcgcaacccggaagcaggtgctggaacggccgcgatagcccttggccagcttgagaatcttcttatgacgggcgtgcgtggtgacgccccgcttgacgcgagccatttatcagcctccgttcggcaggaagtacttcttgacgttgtcgctgtccgtcttgaacagcatgaaggtgccgcgcgcctggcgcttcatcttctgcgacttcgccgagaggcagtgacgcttgaacgccacgttgcccttcaccttgccggtgccggtgagcttgaaccgcttcttggcggagctcttggtcttcatcttgggcatttgcgcttatccttagtctgagtggttcagcgacgacgaacggcaaggcagccctaacagccttgtccgctcaggaaggggaagcttatagcttgggcgatccatgattgcaaggagatggaatcacttccggaccgcgcctgatccaaatcatcatgtcatcccgagtgaacgcgagggatctcatcctggaacggcctttccgacctgaaagcggcattccaagcgacgatccctccgttacttccggttcaccagccagatgccggccgccaccagcgccatggcgccgcccagaccccaggtgatgcgctcacccagcagccatgccccgaacatcatgccgaacagcggcgtcaggaatgaaaacgccgacagccgggtggcgggatagcgggagatcagccagaaccacgtcaggtacgaggcgaaggccacgacgacgatctgcccagccagcgagacccagaccagggtggagggctggccgataatccccgtctcgcccagcagcagcgacgccggcggcaagaccaaggccgagacgcccaactggtagaacagggtcttgctggggcgcaccgaggacaggcgcgaggtgcggatcagcacggtggtgccgccccacatcaccgccgccgccagcagcatggcgtcgccgatcatctgccggccatcgggcagggacagattgtcgccgaaggccagcaggatgccgccgaaggccgcgatcagccccaggctctgcatccggttcaaacgctcggcggggaccagccaatgcaggcacagcgccaccacgaagggcgcggtgtacagaaacaccacggcgcgcgaggcgggggtgaattccagcccccaatagatcagggcgaattcggcgctgaacatggcgcccgccgccagcccggcggccagggaaccgtcggcgtcaaacagccgcacgccccggaagcggcaccagaccagcagcagcagcaccgagccggccgagcgcaaacccgcctgcaacaccggcgaaatgccggcattggccaccttggccgccacctgattgagcccccacagagcgcacagccccatcatcagcgccatggccaaggcgtccagatgggtgtggcgttgggggctcacgccacctccagatcgaaggccgccgccatcagggcgcgggtgtaggcggtcctgggggccttgaacaactcgtcggcgcggcccgcctccaccaccttgccgtccttcatcaccagcaggtcgtcggccagggcgcgcaccacccgcagatcatggctgatgaacagataggccagggcatgccgcgcctggaggtcgcgcagcaggtcgacgatctgggcctgaaccgaaacgtccagcgcgctggtgggctcgtccagcacgatgaatttgggcttgaggaccagggcgcgggcgatggcgatgcgctggcgctggccgccggagaattcgtggggatagcggtcccgcgtcgccgggtcgagccccacctcttccaacgcggccgcaatcaggcggtcgcgctcggccgcgtgcatggcgggctcgtgcacttccagcccctcgccgacgatctggcccaccgacatgcgcgggctgagcgagccgtaggggtcctggaacaccatctgcatctggcggcgcagcgggcgcaaggtcccggcgctcatggactcgatcctggtgccgccgaagctgatctcgccatcggagtccagcaggcgcagcagggcaagccccagggtggtcttgcccgagccgctttcccccaccacgccgatggtgtggccgcgcttcaggtccagactgatgccgtccaccgccttgacatggccgacggtcttgcgccacagccccgccttcagcggaaaccacaccttgaggtcgcgggccgccatcaccaccggctcgccctcgcccgcacggtggggcttgcccttgggctcggccgccagcaggcgttgggtataggggtgggcgggggcgtcgaagacctggggcagcgggccgctttccacgatctcgcccgcgttcatgacgcagacccggtcggccatcttgcgcacgatgcccagatcatgggtgatgaacagcaaggccatgccgagccgggcctgaaggcccttcaacagcgccaggatctgcgcctggatggtgacgtccagggccgtggtcggctcgtcggcgatcaggatgtcgggctcgcccgccagcgccatggcgatcatcacccgctggcgctggccgccggacagctcgtgcggcagggcgcccaggcgcttttccggttcgggaatgcccaccagggacagcagttcgaccacccggtcgcgcaaggtgctgccgcgcagacccagatgcagctccagcacctcgcccacctgagcttcgatggaatgcagcggattgagcgaggtcatgggctcttggaacaccatggcgatgcgtccgccgcgcaccttgcgcaaggcgggttccggcgcccccaccagctcggcgccgtcgaggcggatgctgccccggggatgcgtggcccggggatagggcagcaattgcaggatggacagcgccgtcaccgacttgcccgagccgctttcgcccaccagggccagggtctcgcccttggccagggtgaaggatacgcccttgaccgcctggacgggtccgaagctgaccgccagatcgtcaaccaccagaagaggggtgttttcactcatcaggacgtctttctcggatcaaaggcatcacgcaccgcttcgccgacaaagaccagcagcgacagcaaggtggcgaccaccaggaagccggtgaggcccagccagggagcctggaggttctccttgccctggcgcagcaggtcgcccagggacgccgagcccggcggcaggcccaggcccaggaagtccagcgcggtcagcgacacgatggaggaattgagaatgaacggcatgaaggtcaccgtcgccaccatggcgttgggcagcacgtggcgggccatgatgcgagcgtcgctcatgcccagcgtgcgggcggcccggacgtagtcgaaattcctggcccgcaggaattcggcccgcaccacgcccaccagattggtccaggagaacagcacgaggaccagcagcaaggtccagaagcccggcttgatgatcgacgcgatgatgatcaggatcagcagttccggcagcccgccccagatttccaggaagcgctggaagaccagatccaccttgccgccgaaatagccctgcaccgcgcccgccgccacgcccaccaccgtgctgaccagggtcagcgccagcccgaagcagatggacagccgcaacccgtagatcagccgcgccaagacgtcacggccctggtcgtcggtgcccagccagttgctgcgcgacggcggcgacggatgcttcaccatcggatcgtaattgatggcgcggtagtcgaagggaatgggcggccacagcgcccagcccttctcggcgatcttggccaccagatagggatcgcggtaatcggcataggtcaggaagtcgccgccgaaggtcacctcgggatagtccctggccagggggaaataggtggcgccgtcataacgcaccaggatcggccggtcattggccaccagctcggcccccagggtgaccaggaacagggccaggaagatccacagggaccagaacccccgccggttgcggcagaaggcgtcgaggcggcgacggtccaggggcgtcaggcgcaggttcatccgcccctcccctcgaaatcgatgcggggatcgacccaatgataggtgaggtcgctgaccaggttgagcaccagtcccagcagtgaaaacgcatagagtgtgccgaacatcaccgggtaatcccggttgctcaccgcttcgaagcccagcaggccgatgccgtccagggagaagatgatctcgaccagcaccgagccggtgaacaggatgcccaccagggcgcggggaaagccggcgacgatcagcagcatggcgttcctgaagatgtggccgtagaggatgcgccgctcggagaggcccttggcccgcgccgtgaccacgtattgcttgttgatctcctccaggaaggagttcttggtcagcatggtcaggccggcaaagccgccaaccaccaatgcggttacgggcagggccagatgccagaagtaatccagggcacgggtggcgaaggacgccccctccatccccggtgacgacaggccgcgcaggggaaaccatgcgaagtactggccgccggcgaacaggacgatcagcgcgatggcgaacaggaagccgggcacggcatagccgatgatcaccgcccaggacgacaccacgtccaggcgcgaaccgtcccgggttgccttggcgatgcctaagggaatggaaaccagataaatgatcagcgtgctccacagacccagggagatggaggtgggcatcttctcgatcaccagacccaccaccgaggtgtcgcggtagaagcttttgccgaagtcgaagcgggcatactggaccatcatcagccagaagcgctcgtgcgccgggcggtcgaagccgaattgcctctcgatctccttgatgaaatcgggcgacagcccttgcgcgccgcgataggccccctggccgccctggcccggcggcggcttggcctgggtggtttcccccgaggccgagcccgagacgcgggcggcggcatccaccgcattgccctgtagcttggtgatcatcagttccaccggcccgccgggggcgaactgcaccacggtgaagttgatcaccatgatgccgaacagggtcagcgggatcagcagcagacgccgcagggtataggcgatcatttcttcacccaccaggtcatcacctgcaccccgctggccgggacggtgtcgggcatgccgaacttgtcccaccacaccagccggtccaggcccagatgccattggggaatgacgtaatggttccacagcaggacccggtccagggcgcgggtgcgcgccaccagggtctcgcggtcgggagccgaaatcacctgttcgatcagggcgtccaccgccttgttcttgatgccggccacgttctggccgcccgcctcgtcggcggattcgctgccccaatagcccagttgctcgttgcccggcgactgggactggccccagacatggaccaccatgtcgaaatcgaagtggtcgatgcggttcttgtactgggcggggtccacggtgcgcacgctggcctcgatgcccaggcgggacagattgcggacgaacggcagggtgatgcgctcccaggccggctggaccagcagaatctcgaaggcgaagggcctgcccgccccatccaccagcttgccgtccaccacccgccatccggcctcctccagcagccgcatggcggcgcgcagattggggcggatattgccgtcgccctcggtggcgggcggcttgaactcggcggtgaagacctcgggcgggatttgcccgcgcaggggctccagcaccttgagctccaatggtgacggcagccccagggaggccagttcggaattggcgaaatacgaggcggtgcgcttgtactggctgtagaatagagtcttgttggtccattcgaaatcgaaggccagccccagggcgcggcgaacccggatatcggcgaacagggcgcggcgcaggttgaaggcatagccctgcatgccggccggacgctgattggcgaaggcgttcttcctgccgcgtccgtccttcagccccgtccaatcctcgtaggccgtcgcccacttcttggcctcgttctccgagcgccagtcgtattcgcccgccttgaacgcctccagcgccacggtggtgtcgcgatagctgtcatagcggatgcggtcgaaattgtactcgcccttgcggacggccaagtcggcgccccagtaatccttgacccgctcataggtgatggtgtgctgggtatcgaagccggccaccttgtaggggccgctgcccaggggcggctccagggtggtgacggcgaaatcgcggccctgccagtaatggcggggcagaatgggcaattgcccgacgatcagcggcaattcgcggttgtcgcccggcttgaaggcaaagcgcacccggcgctcggccagcttttccaccttgtccaccgcggcatagtagaagcggtagcggggatggcccttggccttcagaacctcgaaggagaacaccacgtcgtcggcggtgatgggcttgccgtcgtgccagcgggccttgggccgcaggttgaagatcacccaggagcggtcggcgggcacctcgacgctctcggcgatcaagccgtattccgagaacgcctcgtcggcggaattgaccatcagggtctcgaacggcagatcggccccggccggcgggtcacccttgacgataaagggattgagcgaatcccagccgccgatctcggccagccggatctcgccgcccttgggcgcctccgggttgacgtagtcgaaatgcttgaagcccggcccatacttgggcgccccatgcatggccaggccatggacgggatgcaccgtctcggcggcaacggcgggggcaagcagcaggcaaagggcgaggatcagggcacgcatggggccagagtttggggccaagcgggcttgggggcaagggggcactacttggccacgaacggcggcacccggcccagcagggcttccagcatcaccagttcctcgtcggcgtggttggtcaccctatagggctccatcaccggccggcggccggcggggaagatctggcgcggggcgtcgtggtggcgggtcgccacctcctcggccccggcgggatcgcccgtggggatcatcaccgcgcggccgtagcagacgcagacattggtcgatacggaatggctttccaggtacacggccgtgccgcggatacccacattggcgtggggggtcttcagggtgatctgcttggggccgaaaaccgacaggacgcggccgctttccagactgacctcgcgtccggccggaccgtcggaaacggttaccgcgccgtccgagcgcagcaggaaggcgtcgtcgcccagggtgaacaccgcctgggcccccggcccggcggcaaccgtgtcaccggcggcgacggcactgcccaccggggcgggcctgccgttgatcagcacctcgccgtgtccctgccgcagggtcccgctgcccgatggcatggcaatggccgggcgcaatcgcccgaaggccgccagggcggccatgccggtcagcaggcggcgacggttgggaccggtcttgccacaggtgcacatgctcggttctccccaagaaaaagcccccttccgtcaccggaagggggcttcgtcggtctaacgtattcgcagtctagtaccgataggtttcaggcttgaaggggccttcgaccgcgacgccgatataatcggactgcttcttgttcagcttggtcagggtggcgcccagcttggcgaggtgcagcatggccaccttctcgtccagggtcttgggcaggacgtagaccttcttctcgtacttgccgggattggtgaagatctcgatctgggccatcacctggttggtgaacgaggcgctcatcacgaaggaggggtggccggtggcgcagcccaggttgacgagacggccctcggccagcagcaggatgcggttgccgctggggaacttgatctcgtccacctgcggcttgatgttgttccactcgaagttcttcaggccggcgacctggatctccgagtcgaagtgaccgatgttgcagacgatggcgcggtccttcatggcgcgcatgtgatcgacggtgatcacgtccacattgccggtggtggtgacgaagatgtcgccgcggggcgcggcctcttccatggtggcgacctcatagccttccatgcaggcctgcagggcgcagatggggtcgatttcggtgacgatgacgcggcagccctgggacgccagcgactcggccgagcccttgcccacatcgccgaagccggcgaccacggcgaccttgccggccagcatgacgtcggtggcgcggcggatgccatcgaccagcgactcgcggcagccgtacttgttatcgaacttggacttggtcaccgagtcgttgacgttgatggccggccacagcagggtgcccttcttctccatctcgtagagacggtgcacgccggtggtggtctcctcggtcacgccgcggatggcggtgccgttgcgggtgtagaaggtcttgtcggtcgccagcttcttcttgatggaggcgaacaggacttcctcttcctcgcaggtcgggttgttgaggaccgacaggtccttctcggcgcgcatgcccagatggatcagcagagtggcgtcaccgccgtcgtccaggatcatgttggggcagccgccatcggcccattcgaagatgcggtgggtgtagtcccagtactcttccaggttctcgcccttgacggcgaacaccgggatgccggcggcggcgatggcggcggcggcgtggtcctgggtcgagaagatgttgcacgacgcccagcggatgtcggcgcccagagccttcagggtctcgatcagcacgccggtctgaatggtcatgtgcagcgagccggcgatgcgggcgcccttcagcggctgcgacgggccgaattcctcgcgggtggccatcaggccgggcatctcgctctcggcgatgtccagctccttgcggccccaagcggccagggcgatatcggcaacgacgtaatcggtcatgatggtccctcggacaggaatgttccagttgccgcctgtgtaccagccctttcggcaaaacgcaacacgatataaagatatctttatgtgagtatggcccgcccgctacttcaccagactcacattggccgtaccctcggcgcccatgaagacgcacaggatgcggaccgggcggtccgtgaggttgatgccccggtggggtgccgccatggcttccatcagggcctggccctgggcataggtccgccggccgtgggggccgtaatccaccaccacctcgccctccaggatataggcgtacatgggggccgggtggagatgcagggcggcctcggaatggggcgccagcgtaacgatggtcgaggtcaccttggccgggccgctgtcggggtagcggatggtctcgcccagcacggtggtgccggtggacagcagctgaaccgagggataggcctcctcggccagggcggagccgcccagcagcagcgccattgcggcgacgatcaggatacgcatagttccccccctctttggtctcaatgtccctggaagccgtcgagcaactggccgatcttgccagaatcggtctgttccatgaccgtgcgggccagggtctcggcggcggccagatcgagcgagcggatgcggttcttcaccaccggcaggttcgacgtgctcatggacaggtcgcgcaggccgagccccagcagcaagggagcgtagcggggatcgcccgccatctcgccgcagacgctgaccgggatattggcccgctgagccgcctgggtggtgaactggatcaggcgcaacaccgccggatgcagcgggttgtaaagatgagccaccgcctcgtcggaccggtcgatggccagggtgtactgcaccaggtcattggtgccgatggcgaagaaatcggcatgccaggcgatggaatccgccgacagcgccgcgccgggaatctcgatcatggcgcccagccggggcagcggatctggcaggctcacgcccgccttgcgcaggcggcggatcacccggttcatcacctcgcgggtggcgcgcagctcgcccaccgtggcgatcatcgggatcaggatgcgcaccgggccatgggcggacgcccgcaggatggcggccagctgggcctcgagcaggtcctggcgggccagccccaggcggatggcgcgcaggcccagcgagggattggggccgatggtacagcccagggcgggggccagcttgtcgccaccggcatcgaaggtccgcaccgtgaccgtgcggccgcccatgcgctcgaccacgtccttgaggatggcgtattgctcgtcctcgctggggacgtcgtcgcggttcatgtacaggaactcgctgcgcagcaggccgatgccctcggccccggagtccagcacggcacccacttcgttgggcagctccatattggcctgcagcgtgatgcgtccgccgtcgcgggtcacggccggcacgtccttgaggcgggacagcacgcggcgcgccttgaggaaggcggcgcgttcgcgccggtagaaggccagggtctccggtccgggattgatcaccaccaggccgttggtgccgtcgatgatgacctgttcgccgcccttcacgccggtcagcagatcggcgatgcccagcaccgagggcagccccagggagcgcgccatgatggcggtatggccctcgctgccgcccatcacggtggccagtccggccacctgattgggatcaagcagggcggtgtcggcgggggtcatctcctcggcgacgatcaccgcgttcctgggcaaggcggtaaagggacgataggcggtattggtcagggcgcgcagcaaacggcggccgatatccttgatgtcggccacgcgggcggcgagatacgggtcctccatggcctcgaagccacggacgatctcgttgatctcctgctgaacggcggcctcggcattgatgcggtcgttgcggatgcgggcctcgacgccccgcagcaggcgcgagccgtgcagcatctggcgataggcatccagcaggtagcccagttcctcgccggcggccccgccaaggcgccccgccttgtcctgcaactgctcgacctgacggcccgcattggccgaggcctcgttgaagcgggcgcattcggcatccagacgggcggcgggaatgcgcagctcggggacggtgatggtcccggcgtcgtgcagatagagggtgccgatggcgatgccccgcgacacgcccaacccgtcgcggaccagttcggcgcgggccgtcgccttgcttcgtccgaccgccttgctgccgccgttcgccgtcatgaccgggctttcagtcttcgtcgaacttgcggtcgacgagatcgaacagggcgtccatggcttcggtggcctgggcgccggtcaccttcagctcgatggagcagccgggcgccgcagccagcatcatcagccccatgatcgacaggcccgacacctcggtgccgcgatgaccgacggtcacctgggcgtcgaaggtggcggccagcttgacgaacttggcggcggcccgggcgtgcagaccgcgtcggttggagatggtggcggtgcggaccagctccgcgccggccccgcccgaggttccgatcacgtccgacattacttgcgatcctgagtcagcagcttggaggcgacgttgatgtatttgcgaccggcctcctgggcgctggccacggcatcggccagggcctcggaatggcgcacgctggccagtttgatcagcatgggcaggttgacgcctgcgatcacctcgaccttggccttgtccatgatggaaatggccagattggacggcgtgccgccgaacatgtcggtcagcaccaccacgccggcgccgtcgtcacagcgcgccacgctggacaggatatcgttgcgccgctgctccatgtcgtcgtcgggcccgatgcataccgccccgacattgggctgcggccccaccacgtgctcgagcgcggcgacgagttcgtcggcgagccggccgtgggtgacgagtaccagtccgatcatctcaatcccccttgaacgggcaaaaggccagccccaccggccccgatcccgcgcgtcttgcacagtgacatcatgaaccccgttcgtcgagttcgcgatggcgaagctcgacctttccgccccgtcgttgcatccactgcgctaggtgctcggcgatggcgacggaccggtgacggccgccggtacagccgacggcaatggtgagatagctcttgccctcggcggcgaagcgcggcagcagcggctccagcaggcgggtcagcgactcgatgaacggcccgaaggctgggtcggcggccacgtattgggccaccgccggatcgcggccggtcagcggcttcagctcgggcacataatggggattggccaggaagcgggcgtcgaacaccagatcggcctcgcgcggcaagccgttgcgataggcgaaggaggtgacgaacacgcccaggccgccattgctctccagcccgaaatgcccggccagcaggcgcttgaactcgccgggcggctggttggtggtgtcgatcatcacgtcggcccggcgcttgagcggcgacaccagggcgcgctcgtggcggataccgtccagcagcgggcggtccaccgccatgggatggcgccgccgcgtctcggtgaagcggcggcacagcacgtcgtcctcgcaatccaggaacagcagccgcacgtccaggccgctttcgcccatcagatggtccagggccgccagcaccggctcgacgccgaaatcgcgggtgcggatatcgacgcccagcgccaggggacgggccatgccgccgccggagcgcaccagactggccgccagggccagcggcaggttgtccaccgcctcccagcccatgtcctccagggccttcagcgccatggtcttgccggcgccggacatgccggtgacgatgaccacgcggttgccgcccccggcatgggccggagccgaggtctgatccgtcgggctggagtgcaggtcgctcatcacggcggcattatatctcgcgttgaagcgcgcatcgcaaggcgaaccttcgccgccgccgatgcctcgaagggggccagcagcagatggcgcagggtcaagcccagcaattccagggcgctcgcctccggcagccgttccaccgccgatggggcgaccagatcgaccaccaaatccagcgccacgccgtccagatggggaaggcggaccagccccaggccgcgcacctccagcagaccggcgatggtggcgggcgggcgggcgatcagggcctcgccatcgcggtccagcgccgtctggtcgtcggccaccagaatcgccccgccgtcgatcaggcggagcgccagatccgacttgccgcttcccgaaggaccgcgcagaagaacgccgcggccatcaatggccacgcaggtgccgtgtacgaaggtcatgggcaaagggtggcgacgccgcccgccgaagtcaagacgggccagccccggaaacgctcatggcccctgaaacgctcatggccgggacgacccggccatggcgaagggagcaagccgcctcggcgactcagcgcgagaccttctggatcctgggatgaaccggatcctggccgttgtaaaacggccaatcgcccgaggccacggcgtccagggtgtcagacttctggccaagccggctttgatagatccaatagccggtcatcacccgctgcacgaagacgcgggtctggcgggccggcaggctttccaccagcaacagcgggtcgtcgttgtgacggatattggtcagccagcggcccagattgccgggaccggcattataggcggccgccattagcagaagattgccgttgaccggctcttcctccagcagcttggccacatagcgctggccgaggccgagattatgctcgggatcggacaggcgggcaccggcgccccggccaccgatggcggcggcggtggcaggcatcagctgcatcaggccggcggcaccgacccccgaccgggcggagggattgaacgaggattcctggcggaccagggcgaagaccagggccttatcgatctgccagccgcccttgggcgtccagtcgggaacgggaaaggcggcggcgtcgtgcaggcggccgttctctcgcggcagcgagccgcccagactgaccgccagggccggcatctggccggcataggccatgaccagcatggattgccgcagacccttgctggcgttgggatagagcttgcgcagctcttcctcggcagcggcgcggtcgcccagctgcagcaggcccagggcgcggcgcgccccggaaacgcgcatcagcagatcggcgtcgccctcggtgaagggcggcacttcccacgagaattcggaaccatggcccaattcggcgcgggccagcaggccgtaataggtgcgcgacgaggtggcggccagttccagccagtgattgaccgcctcgggacggcgggtcaccagattggcccgcgccgcccagaacgcaccggcggcggacagccaatcctggccgtcggaatacttggccacttcctcgaaatggcggcgcgccacgtcgggcttgcccatgcgccactgggccaggccggcgatccaatgggcggcgggcaactgctcgcccgagcgttcggccgagaggccggccagggtcgcggcgggctcgtcgcggccgccggcgaagtgatcggcggcaaccatcagccgcatgcggtcgaagtctagctcggacagggattgcgcctcggccgatgccatcatggcctcgacgcgggccggctcctcgtcgcgcagggactggcgcagcttggccttgaacgccttcaccttggcggacgacgaatccacgtcataggccacctcttcccaggtggcgccatcgtcctcggaggaaatgccggtgcccttgaggccgcccttggccggagcgcgcaacgcgccgccgcccttgacgcccttgagacccttggccagcttgtgaatggcctcggcctgcggcagatcggcgtaatccgccagccaggcgcggatttcctggaacttgggcttggctcccggcgccatcagacgctgggccagcacatggcccttcagcaattcgtcgcggatcttgcccagttcgcggtcggcggcggcaaactggcccgaggtctgcagcgccatcacccgcttgtagaggtccacatcgcccgccgacagcggcttgggcaggggggccacgcgggcttcacgattggaaccgggaaggatggcggccgtctgggcgccgtcggcggcggcgattcgcaccttggccggcttgacgggttcacccgccagggccggagacgtcgccgccatgatcgccagcatcactgccgggaggagcctgtcgcgcaaggctgttctcctctgaattcgctgcgggaccgattcgcccgtcgctcgcggatcgcgcgccgggatcggaccactgggttatcgacaaaaccaatcgaggtccccggttttataaatgacgccccccgccagagcaacgaaaaacgactcgcgattcataaacagattgtaaaattccattacagaacaatgacttgttctttgctgccgagtcctggtggcagcagagccgcctaaccgccataatggggaaatgatcgtctcggccagctatcgcaccgacattccggccttttacggccgctggttcctcaaccgctttcgcgccggatgggccaaggcggtcaatccctatggccgccagatctccaccattccgttacgaagcggcgtggacggcttcgtcttctggacgcgcaatcccggcccgttccgcgacgccctggacgagatccgccgggcgggcctgccctttgtccttcaggtcaccctgaccggctatccccgcgccctggaaagctcggtgatcgaggtcgagcgctcgctggccctgatgtccgatctggcccgcgcccatggcccccgggtggtggcgtggcgctatgaccccatcctcgccacctcggccaccccgctggactggcacgaggacaatttcgccaggctggcggcgcggctggagggcatcaccgacgaggtctcggtgtcgttcgccaccctctaccgcaagaccgagcgcaatctggcggcggcggcgcgcgcccaccacttcggctggagcgacccggcgcccgaggacaagcgcggcttgctgcgcagtctggcggaacgggcggccggtcacggcatccgtctgacgctgtgctcgcaacctgatctgctgacggccggcattgaaccgtcgtcctgcgtcgatgcacggcggctggaggatgtggcgaagaattggggactcgatcggcggatcgccgccaaggtcaagggcaaccgccccggctgcctgtgccacgaaagccgcgacatcggcgaatacgacacctgcccgcacggctgtacctattgctatgccgtgggctcgcgcaccctggccaagcgccgcttcgccgagcatgacccggactcggaattcctgctgccgccgccctggctggacgccgtggaaaagccgcagaccctgctgtgatgcagaggccgtgacgacgtcacggctaggcccaagggggcgcgccgcttatgcggcgaaagccaagccgccaccggcggcgcccggcgattgaggggcagcaaaaataagtgcggcggccggtgccagggggggaagcaccggccgccgcgtctggccggctcaccgcccgtagaggggacggggggcgggagccttggtggggggccatggcggggatcatgggaggcaattgtggcgatttcatggacgccatgcgaaccggccccaagaatttgtcttttccccaggccggggttgggggtagttttcttccgcttgaacccccacttaagggtggtatcctgcgcgccggacaccggggacctcggcaacagccaaggtcgcggtgtttgcgtgcgtccaacggatcggccgaaccacccggaagtggggccgcaaccttgatcgagaggattacgccgtgcttgaagcctatcgccagcatgtcgccgaacgcgccgcgctcggaattccccccctgccgctgtcggccgagcagaccgaggctctggtgggcctgctgcagaacccgcccaagggcgaggaacaggccctcgtcgatctgatcacctatcgcgtccccgccggcgtggacgacgccgccaagatcaaggccgaattcctggacaaggtggccaagggcaccgtcgcctgcgcgctgatcagccgcgagacggccacccagctgctgggcaccatgctgggcggcttcaacgtcaagccgctgatcgagctgctgtccgacgccaaggttggcgccgtggccgccgaggggctgaagaagaccctgctggtgttcgacttcttccacgacgtcaaggaactggccgacaagggcaatgccaacgccaaggcggtgctgcagtcctgggccgacgccgagtggttcacctcgcgtccggaagtgccgaagtccctgaccgtcaccatcttcaaggtgaccggcgagaccaacaccgacgacctgtcgccggcgcccgacgcctggagccgccccgacatccccctgcatgccctggccatgctgaagaacccccgtcccggcatcgaagccgacgagcccggcaaccgcggccccttgaagcagttggacgccctggccaagaagggcaacctggtggcctatgtgggcgacgtggtcggcaccggctcgagccgcaagtcggcgaccaattcggtgctgtggttcaccggcgaggacattccctacgtccccaacaagcgcttcggcggcgtgtgcctgggcaccaagatcgcccccatcttctacaacaccatggaagatgccggcgccctgcccatcgagctggacgtcaaccagatgaacatgggcgacgtggtcgaactgcgcccctatgagggcaaggcgctgaaggacggcaaggtcatcgccgaattcaccgtcaagtccgaggtgatcttcgacgaagtgcgcgccggcggccgcattccgctgatcatcggccgcggcctgaccgccaaggcccgcgaggccctgggtctgccggtctccaccctgttccgcctgccggccgttcccaaggacaccggcaagggcttctcgctggcccagaagatggtcggccgcgcctgtggcctgcccgagggcaagggcatgcgtcccggcacctattgcgagcccaagatgaccacggtcggctcgcaggacaccaccggccccatgacccgcgacgagttgaaggatctggcctgtctcggcttctccgccgacatggtgatgcagtccttctgccacaccgccgcctaccccaagctggtggacgtcaagacccaccgcgagctgccgggcttcatctccacccgtggcggcgtggccctgcgtcccggcgacggcgtcatccattcctggctgaaccgcctgctgctgcccgacaccgtgggcaccggcggtgattcccacacccgcttccccatcggcatctccttcccggccggctccggcctggtggccttcgccgccgccaccggcgtcatgccgctggacatgccggaatcggtgctggtgcgcttcaagggcaagatgcagcccggcgtcaccctgcgtgacctggtcaacgccatccccctttacgccatccgcgccggcctgctgaccgtggagaagaagggcaagaagaacgtcttctccggccgcatcctggagatcgagggccttcccgacctcaaggtcgagcaggcgttcgagctgtccgacgccgccgccgagcgttcggccgccgcctgctcggtgcgcctggataaggctccgatcatcgagtacatgacgtccaacatcaccctgatgaagtggatgatcgccaacggctacgaggatgcccgcacgctgggccgccgcatcaaggccatggaggcctggatcaagaagccggacctgctggcccccgatgccgatgccgaatacgccgccgtgatcgagatcgatctggccgacgtcaaggagcccatcgtcgcctgcccgaacgatcccgacgacgtcaagctgctgtccgaagtggccggcgccaagatcgacgaggtgttcatcggctcgtgcatgaccaatatcggtcacttccgcgccgccggtaaggtgctggagggcaagtccgacatcccgacgcggctgtggatcgcgccccccaccaagatggacgccatgatcctcaacgaggaaggctactactcggtgctgggcaaatcgggcgcccgcatggagatgcccggctgcagcctgtgcatgggcaaccaggcgcagatccgcaagggctcgaccgccatgtccacctcgacccgcaacttccccaaccgcctgggcatcgacaccaacgtctatctcggctcggccgagttggccgccgtctgcgccctgatgggcaagatcccgacggtcgccgagtatctggagcaggtgaacgtggtcaatgccaaggccgccgacgtctaccgctacatgaacttcgacaagatcgccgagttcagcgacgtggccgccaaggtcgccgtctgaaccgacggaacctgatcaaggcaaagcccccgccgggagaccggcgggggctttttcctgtcggggggtgtcgatgatgacccccttcgccctcagtgccccaccccggcgatctgctcggacagggcgacggcggcgcgctggcgcttcttggcgtcctgggtctcggcctgatacttcagcacatagggcttcatgcgcagatcggactggatgatgtgatcgaccagccattcgcgtagaaagccgcccagcccgcggatcatctcgtcacgggccgtcccggtggcctgggtgtattgctgggcgattcccgtcagctgcttgagaacgtcccggtgcccatggcggtgggaatcatggtaggggtagcggatcagcacctggatctcttcctcgcgcttgaaatgggcgccggtgtattccaccagccccagcagcacgcgggcgacccgcttgtggtcgatcttgccgaccacggcagcctcgaagacgttgatcatgtcgaccagatgccggtgatccgcatcgatggtctcgtcgcccacgctcatggcctcacgccacgcaatggtcatggcctcgccccttttctggcccacccctcaaagaggatagccggggcgcgacaactggggccatatccatttcggtaaagttctaccgatggcagcgataccttggtataggggctgcttggcaggctgcggagagacccccctttgggggcttttgcccccgatcccccaatcgggaagcaccgcttcccgaacccttcagctttttaaaaatgctggaggttcggaggctgtgcctccgaacgggtcgaggcggtcgccctgccgcgcagcggggttcttccccagcctgccagagcgcgtcagtttcaaactgaagaactctaacctcgccgcgcctggacccggcccagccgggcctgatcgtaacgattcaggtcgttacggcggatcagggcgcggatggtctgcacataggcgtcgccgcgctcggaataggtggacaaggctgccgccagggcatggccatccggacgcatcccctcggcgcgggcctgagcgcgggcccggcgcagcccgtcataggcgcggtgggtgttgaggttgtgcacataggcgcgcaccgcctcgtacagggtagcgaagctgcgcatgccgctgccgtcggccgagacttcgaccgtgtggccgaacaggttgcgcgagcggcggaccagcttggaggtcccccagccggattcctcggccgactgggccagggccagggacggcggcaccacgtcgacgcgcgacagcagcttgcgcaggttgccgtcctccacgtcgtagcgctcggccagttcggccagccaggtgtgatccgatgccggaatatgcagacggttggccttgcggttcatgatgtcgagcaggcgcgagcgctctgcggcgatttcctcgtccaccgccagtaccagcggcagcatgacgcgcaggaacaccgccttcttgccctcgatgtcgggcagatcgtcgatatcgccgggaacattggaaaggaacagcggcggcacctcggcctgaccggcggcgaccgcctcaaggcgatagcccatgcggtcgagggccagattgaggcgggcggcgctgctgacgtcatcgccggtgaggcttgcggcttgcggggcggcagccggctggacctgggggcgggccaccgcgacaggcgcggcggtatcatgaagtaccatccagtacagaccgccaaccgcgccgagaacggcgaggacactaagggcggaaaatactcgggatccgatcgacccgactcgcatacggcgcggcctccgtttgttgcagtgcaatatcgaggaggactttacccgaggcgattgaggtaaatcaacccaaaaccgcctgatatacgaacggaaacagaacatgccccgggccggagccacggggcatgccgattaaaccgagaataaagaggcggttagtccaccgcctggacggccatcacctcgggaacataatacttcagcatgttctcgatgccatgcttcagggtggcgctggacgaggggcagccggaacaggcgccctgcaggtgcaggtagacgatgccgtcctcgaaggcgcggaagatgatgtcgccgccgtcctgggccacggccggacgcacgcgggtgtccagcagctccttgatctgcatgacgatgccatcgtcgtcgcccgacgcggccgccgcctcggagccgggattgatcaccggatcgccggaattgtagtggtccatgatggccgccagcacctggggcttgaccacctgccagtcagcggcatcgagcttggccacggtgatgaagtcggtgccgaggaacacgctgcccacgccgtcgatggcgaacaggcgggtggcgagcggcgagcccgaagcccgcgaggcctcggcgaaatcggcggtcccctggcccatcaccacggtgccgggaaggaacttcagggtggcgggattgggggtgggttcggtctggatgaacatgggggtccttacgcttcggagcacgaaaactgcctctagtagatggcgacgcctatctccgagtcaaggagtaggatgaagcccgaccgacgtcccgatgaattcatcggggcgcccggcgattgagggcgtatcctaggtgatggcatcgatctgttcggccgtcaggctgccgggaaccagggtcaacggcacgcggagcttgccgatatatttccccgtcagcgccgtcaccagtggccccggaccacccggcccggtatcggcggccagcaccagcaccgagatggagggctcttcggtaatcagggcgatcagttcgtcccggggattgccctcgcgcacatgaagcaccggaagatggcctgacatctggttgacgtcgccggccagacggttgagcaattcctccgccgcctcgcgggcctcggcgcgcatcagattgccgatggaggcgaaatgctcgtactcggtgggctcgatcacccgcaacagcgccacctgcccgtccgaggagcgggcgcggcggcaggcgaagcgcaacgccgcctgcatctcgggcgaatcgtccacaaccaccaggaaaacacgattggtcggcatgatgtcctccccggaaatgatcaggctttcttgaacaccaccgccgccagccagccggccagagccgccagcgcgatggcgatgagaccgtaggccgccgcctgatgatgggcgaagtcaaagacatcggcaccgatgccgatcttgctgaccaccagcggtgtggtctgggcactgaccacttggccgccggacatcagatagacctcgaccatatagacccccaccggcacgttggcggggaaatgcacgtcggtgcggaacaggcgctggctcagcatgccgatatcgagcaccttgtcgccgtacaaccccttcttctggttcagccggaacagggcctggcggtactgttccaggttggaccccgcatccttcacccggatgtccagatccagatgctccagcccgatctgatggcggtccaggatggcgggcgacgccagctggtccagcggacgggtcgaggccacctgatagaacgagggcgcgttgtccaccttggcgatgccggagttgatccagatgccggcggtacggtccttgcgccgcagggtctcggccttgttggggccgcgcaccaccaccaccacgtcgcccgctttgccgccgtccatctcctcgatggcgccgaacagcagcacgtccgttccggcgaaaccggtggtgatggccaccagatgcttggacagatccgccaccagcggctccaccgcccaggcggacggagccgggatcagcaggacgagaagaagaagcaggcgtttcatcagtgcttccctcccgtcccggcggcgaacaattcgcccggcaccgtgaccatgtcgaagagcagcttgacgcacacgcccagcaccatcaaggccagcagcgaccgcaattgctcgcccttcagcttgacgccgaagcgggcgccgacctgggcgccgatcacgccgcccagcagcagcagcagggccagaaccacgtccaccgtgtggttcatggtcgattgcaaaaaggtggcattggcggtgacgaagatgatctggaacagcgaggtgcccaccaccaccgccgtgggcatgcccagcagatagatcatggccggcaccatgatgaagccgccgcccacgcccatcagggcggccaggatgccgaccagcaggccgatggcggcgggaacgatggcgctgatatagagctgcgaacggcgaaagcgcatcttgaacggcaggccgtgcatccagctgtgctggtgcttcttgcgcaccggaacgttaccgccgttgcgcttgctggccaccagcgcctggatgctttccaccagcatcagcgaaccgacgatgccgagaaagacgatgtagagcagcgagatgaccagatcgatctggcccagaccgcgtagccacttgaagacataaacgcccagcgtcgagccgacgaagccgcccagggtcaggatcaggcccatcttgacgtcgacattgccgcgccgccaatgggcgagaacgccggacaccgacgacgcgacgatctggttggcctcggtccccaccgccacggtgggcggcacgcccaggaagatcagcagcggcgtcatcaggaatccgccgccgactccgaacaggcccgacatgaaccccaccccgccacccaggcccaggataacgaagacattcaccgacatctcggcgatgggaaggtagatctgcattccttccgccccctctgccccatgcactctcaaccggtgcttacggggctctttggttgtcgctccaaccagggggcgatggcaacaggaattttatggttttctaatgttctgtcttcccgggttgccgaacgccccaccgaagggtcatcccgagccatggcgagggatctccttctggaacggtgttttcaacctgcccccatatcccaggcggagattcctcctcccgatggtcgtcggaatgacagaagcacgacgctatttcaacgccgccagcatctcggcggcctgcatgcgcacccggagcgcggcatagccctgcgccgccagatggttgggcaggaagctggaatcgggcgcggcgctccacaccagccaggggcgcagccgcgccgcgccggccagctggtcgaccatgcgggtccaggcctcggtctggcgccggtcggccagcaccttctcgaaatcgcggcccaactcacgcagcacgatggaataggcgtaaagccgccccttattgccgtagaacaccccgtcgacgctgaaatccagcagcaccggccgcttgtcggccagatggtggtcgatggcctcggtgacctcgtcgagatcacggatcagcgcctcgaccgcggcggccagcgcctcgggcttgcgctcgaacgacgccgagccagccgcgaccatgtcgttgtagagatccagcgagcgttgggcgttgcggtactgcttctcggccgaggcggtgggcagccaggatttgtgggtgtcgaacttccacaccgtgccgggatatttcagcagcccggcggcgtggttgaggttgacgtcggtgccgttggggccgaaggctacgcccttctcggaattcagcgcgccgaccaggcgggacagcccacccaccaggcccaactggaaggccggcatgtcgcgcagccaggcgccaggcatgaagaaggggtcattggcgtgccacttgctgacgtccagctcgcgcccgaccagggcggcggccaccgccacgccgcgcgagcggggggcggtggcatttcccgaggcgaagtcgggattgtcgtccaccttgctgatcaccagcatggcgatggggaagaccagcaccaccaccacggcgaaggcccacaggacgaaacggcgcgacggatggcgcagcacggcggccacgcccgccagggcggcggcgacggcgttcagcagggtttcggcgaagcgctgggtcacggccgcaggaacccgacgatgtcgtagacgtccttgatgatcggcgccgcgatggcgtcggcccgttcggcacccgagcgcaggacggcgtcgatatgagcggtatcggtcatcaggcgcttcatctcggtattgatggggcccagcaccgagacggccaggtccaccaattccttcttgaagtccgagaactgctggccttcgaactgggtcaccacctgggccttctccttgccggacagcgcggcgtagatccccagcaggttggaagcctcgggacggccttcaagcccttccatggcgccgggcaggggctccaggtcggtcttggccttgcggatcttcagggcgatggtgtcggcatcgtcggtcatgttgatgcgcgagtaatcggactcgtcggacttgctcatcttcttggacccgtcgcgcaagctcatgatgcgcgccgcctcgggcggaatgatgggctcgggcagcgggaagaactcgacgccgaaatcgttgttgaacttctgggcggtgtcgcgggccagttccagatgctgcttctggtcctcgcccaccggcacatgggtggccttgtaggtcaggatgtcggcgctcatcaggttgggataggcgaacagcccgaccgaggcgttctccttgtgcttgcccgccttgtccttgaactgggtcatgcggttcagccagcccatgcgcgcgacgcaattgaagatccaggccaactgggcatgggccggaaccatggactggttgaagacgatgtgcttggccggatcgacgccggcggcgatcatgccggcggtgacctcgcggatgttgcgggtcagctccttggggtcctgccacaaggtgatggcatgcatatcgacgatgcagaagatgcactcgtacgcgtcctgaagccgcacccagttacggatggcgcccaggtaattgccgagatggaggttaccggtaggctggacgccggaaaaaatgcggttcatgacgggaatggactccgggaaagacaatcaggggtccaggtatactccctggcccggccaaatcaaccccgcttgcggcgaaccatccccttgatctcccccaggctcagcgcacccagcatctgggccgccgccaggaaggcgatggcgcccagcaccaccagaccggccagcacgcccaccgccatcaactgcccctgggccaggggccacagggccagcttgccgccccacaggaccccgcccatcacggcgcaggcggccaagatgcgcggcgccttggatttcagccgctcgtccacggtgaagaatccgcgccgggccagcagcaccgccaggatcaggacattggcccaggcggcgatggcggtggccagcgccatgcccacatggcccagcggcttggccagcgacaggttgagaacgacgttcagcaccatggcgacacccgccacccgcaccggcgtgccggtatcctcgcgggcgaagaagccggggaccagcaccttgaccagcacgtaggccggcaggccgatggcgaaggccaccagggccgacgcggtggccgccgtctcgttgggtccgaacgagccgcgctcgaacagcacccggatcaccggggcggcgatgaccatcagggccaccgccgccggcagggtcagcgccaaccccagttccatggcgcggttctggctggtgcgcgccgcctccgcctcgccggccttcagctggcgcgacagggtgggcagcagggcggtgccgatggcgatgcccaccacgcccagcggcaactggttcacccggtcggcataattgaggtagctgacggcgccgtcggccacggtcgaggcgatcatggtgttgatcaccagattgacctgatagacgccggcgcccacggcacccggcacgatgcgcttgaacagcagcttgacctcaggcgtcaggcgcggccgcaccagccccagccccatgccgacccgccgggcagcgcgggacagccagacgaactgcaccacgccggcggcgaaggtcccccaggccatggcatgaccggcggtctcggaatagggcaccaggaaccacagcccggccatggaagtcaggttgagcagcaccggcgtggcggcggcggcggcgaagcggcccatggaattgaggacgcccgcctgcagcgacaccagcgagatgaacagcagataggggaagcagatgcgcgagaattccaccgccagcgccatcttgcccggcaccgtgtcgaagcccggcgccaggccgtagatggcccagggcatggccagttccatcaccgccacgaacagggcgagcgccagccccagcacggcgaaggactgctcggcgaagcgacgggcagattccgtaccctcggcggtcatcttgccggtgaacagcggcacgaaggcggcgttgaaggcgccctcggcgaacagcgagcggaacaggttgggaaagcggaacgccacgaagaaggcgtcggccaccgccccggcgcccaggaagtgggcgatcatcatctcgcgcatcaggccggtgacgcgcgatagcatggtgaaaccgccaatggtggcgatggagcggaacagactcatggccgcactattggggcaagccctcgccgacgcaaggggatccggcaagattcaactggaagcattgctcggtcaccggcttgccccaggtctcgccggtcagttcctgggtgaggacgaaaccccgggcctcatacagccttcgcgccgcatacagcccgtcgaaggtccacagatgcaccgaggcgaagcccttctcccggcagaactccagggcggtgtccaaaaggcgcgagcctgcccccatgccctggcggttgggatcgaccatgaaccagcgcagatgcgctccggcctgcagccccttggcgccgtcgatggccaccgatcccaccatccggtcgcgggaatccacggcgcaccacagctggctggcgaagcgatggcggtcgcgcacgaaggcggccagctcgctggccaccttggcctcgaaataaggtccgaaattccagtgcagagcgtaatagcgcgaatgcatcgccgcaatgtcgccgatggccccgggttgccatcccgccacgatgtcgacctcgtccttcatctcgtcactcctgccatgccggagaattctgacatggcagggccacgatgactacaggagcagcaggccgagcaaccagtagctgccgccgggcagggcggcgatcaacagattggtggaaaggtcgttcatggcgtatcctccccgaggtcaaaatagccattcagttcgtgtggctattaagcacctcgggccccggaaatgcgacggatcatccgtattaaggtgttcacagtattttccgggggttagcggacgaccaggacacccttggccgtggcctcgtgatactcgccgaaaaaggggtattccccgggctcgaccttgcccagcaccacccggacttccgcgccgggaaagacgatcttttcccgccgaagcggcaggcactcgaattcctcgggctcggcatcctcgttcttgatcagcaggatcaccttggtccgggccggaatttcaagacgctccgggctgaaacgatggttcttgatggtcagcttgaccagcgtctcgtccgcggccatggcggcggggctcaagacggcgagcagcagggcggcaaggacgatgcgggcgagggcgagcatggcggttctcttcgaattgcgatcaactctcattctcatactcaagtcctagccctttgtccagaccaggattgtggaaatccgaatccaatcgttaatgcattgttttggcggatgtttattccgatggcccccgccgttgcgggtggccggtttgtccggacaaaaactacggctgttgacaggccttcggggagcggctaccacagcaaatgcgagtcacttgcatttgcatcaccttcccgcagaggccccccatgatcaaacgccagaccacccttcccgtccttgccccggcccttgcgctggcggcgggattgttcgccgcctccaccccggccctggcggtggaatatcccatcggcgcccccgagaaccgctacggcatggagatcggcgccgtctatctccaggcggtgcgcatggagcccgacggcatgatggcccagcccgagcagtcggacatccatatcgaggccgatatcaaggcgctgcagggcaatcccaacggctatcccgaggggtcctggattccctacctgctggtcagctacgagctgatcaaggaagacaccggcgaggtgatcaagggcgacatgatgcccatggtggccagcgacggccctcattacggcgacaacatcaagctgaaggggccgggcaagtacaaggtcacctacaccgtctatccgcccaacgcccccgagaaccaggccggcaagcattacggccgccacaccgaccgtgccaccggcgtgcgtccgtggttcccggccttcaagctgaactacgagttcgtcttcgccggaatcggcaagaagggcggctattgatgcgcgcccgtcgtatcgccaccgtggcggcggccggcatgatcgccgccgctccagccctggccgccgctcccaaggacccgtccaccgcggaattgctggccgagatcaggcgtctggccaaccgcgtcgaggaactggagcgtaagaagcccatcgccgccagcaccgagcagcgcctcgagaagctggaaaaccacaatgccgccgtggaaaaggccctggatcaggacaccatcagcgagaccgagccgcaggtggccgcccgtcttaaggccgccgaatccgaggtgctgtcctataagaaaggctccaaggtcatcgacgtgctgggcggcatcaaggtgggcgccggcatgagcgtggtcggacagaacctgctgggccagtcgcaggaaaaggatggccagctcaactggcgcggcgacgtgaccctgaccattcccggcggcagcgtcggcgattccaagggcaccatcttcacccatctgcgcatgggccagggccgcggcctgggcaatgtcagcaattccatggcctcggtcaacagcacggccttccagcgctccggtgccgacaataccgatgccgccatcggcctggtggaggcctggtaccagttggacatgccgttgggcggcgacgcgaagaccgccaagcagcacctggagatcaccgccggcaagatggatcccttcggcttcttcgacaagaacgccgtagccaacgacgagaccctgtacttcatgaactcggccctggtccacaacgcgctgctggatgccggcggcgacgtgggcgtcgatccgttcggcttctcgcccggcctgcggctggcctatgtcagcgacgccgacaagtggaaagtgcaggcgggcgtcttcgagagcggcaccggagcatccttccagggctccaacgagttccccttccgcatcgtccaggccgagaccaccgagcgcttcttcggcggattggaaggcacctaccgcgtctacgcctggagcaacgaccgcgccaccgacttcgacaacaagcgggggcgccacgccggcctcggcctgtccctggaccagaaggtggatgattacgtcaccctattcggccgctatggctatcagttgaagggcaagacccgcttcgaccagagcgccagcatcggcggcgaggtcaacggttcgtactggggacgcggtgccgacggcttcggcgtcggcctagtggccaaccacctgtccaagacctaccgcgacaagtccgagacgctcgacgccgaccaggacggcgcgcccgatgtcggctacaaggccacgtccttcgaacagacggcggaaatctactaccggtaccgcgtcatgccccggttcgacctgacccccgatctccagatcatccgtcatcccggcggaaatccctcgggggaggtggcctatgccgtggggctgagggggcaattgacgtattaacaggtgcgaataactctgcgttgcaatatcaatgtagccatgccccgtgaaagcggggcatggttccgcacttcgaggcttcgccatgaccgccatttcgttccgttccacaccgctggccgtgctcggccatttcctggcccgacagtcccggatgatccaggcggtgcaatggctgatggtggtcgtctatctggccctggtcaccctgcccgccttcctgccggtgcccgatgattccaagcacatctgggacaacctggtgctgttcgcccagttcgccttctggggggtgtggtggcccttcgtcatggtcagcatgctggtgatgggccgggcctggtgcgggctgttctgccccgagggcaccatgaccgaatggatcagccgccatgggctgggccgggccattcccgcctggctgcgctggaagggctggcccttcgtcgcattcgtctgcaccacggtctacggccagatgatcaccgtctacgaatatcccaaggcggcgctgctgatccttggggcctccaccgtcatggccctgggcatcgggctggtctatggccgcggcaagcgggtgtggtgccgctatctttgcccggccagcggggtgttctcgctgctgtcgcgtctggcccccgtccatttcgccgtcgacgccgagagctggaagacggcgccgcgcacccatgcggtcaactgcgccacgctggtggatgtgcgggccatgaccggcggcggatcgtgccacatgtgcggccgctgttccggccatcgcggcgcggtggagctgcagccccgcctgcccggggcggagatcgccgccctgccggcccgcgaggtgtcgccctgggacatcatcctgctgctgttcggcgtgatgggcgtggccagcggggcgttccagtggtcggcctcgccctatttcatcgccctgaagcaaggtctggccaagatccttgtggagcattccatcctgttccccatgaccgagaccctgccctggtggctgctgaccaattccgacgagaccggcgaggtcttcaccctgctggatggcttttgcatcctgacctatatgggcggtgccgcgctgctgttcggcaccatcggcctggccgggctggccgccgccgcccggatgctggggcaaaggcagcttctgtggcggctgggctatggcctggtgccggccggggcggtggggctgatcgtcggcctgtcggccatgaccctgacccagctcaccgccgagggggtatttctcgcctgggtgcccgatgcccgcgccgggctgctgctgctggggctgggctggagcgcggcgctgctgtggcgttcgctgcccgccgccgccctgtggcgccgtgccgccgcctggagcctgggcatggccggagctttcgcccagctcggcatgtggggggtgttcttcttcgtctggtagggtataggattcctccccagagcgacgcggctttggggggcgatgatggtgcatccggttgaacttcccgcctggaaggagttggaggctctggccgccaccaccggccggcggcccatgcgcgacatgttcgccgaggatcccggccgcttcgaccgcttctccgcccgcctgggcgatctgctgctggactattccaagaaccgcatcgacgcccaggtgatggccgccctggtgcgcctggccgggcaggcgggcctgcccgccgcccgcgaggccatgttcggcggcgaggcgttcaacgtcaccgagcaccgcgccgtgctgcataccgcgctgcgcaaccgctcggaccggccggttccggtggacggccatgacgtgatgcccgagatccgcgccgtgctggcccgcatgaaggacttcgccgggcgggtgcggtccggcgactggaaaggcgccaccggccgccccatccgcagcgtggtcaatatcggcatcggcggttcggatctggggccggtgatggtcaccgaggcgctgaagccctatcagaaggccgatctggccgtccacttcatctccaatgtcgacggcagccacgccgccgaggtgctgaagctctgcgatgccgagaccaccttgttcatcgtggcgtcgaagaccttcaccacccaggagaccattgccaacgcccgcacctgccgcgcctggctggtggagaagctgggcgaggccgccattcccgcccacttcgtggcgctgtccaccaatggcaaagccgtggccgaattcggcatcgacaccgccaacatgttcgggttctgggactgggtgggcggccgctactccctgtggtcggccatcggcctgtccatcgccctggcggtgggcttcgagcgcttcgaggagctgctggcgggcggccatgccatggaccggcatttccaggacacccccctggaggccaacctgccggtgatcctggggctgatcggcatctggaacgccaatttcctcggcgccgacgcctatgccgtgctgccctacgatcagtacctgcatcgcctgccggcctatctgcagcagctggacatggagagcaacggcaagggaaccgcccgggatggcgccacggtgagctggggcaccggccccatggtgttcggcgagcccggcaccaacggccagcatgccttctaccagctgatccaccagggaacccggctgattccctgcgacttcctcgcggctgccaacagccacaatcccctgggcgagcaccacctgatgctattgtccaacgtgctggcccaggccgaggccctgatgaagggcaagaccggggccgaagcccgcgccgagctggaaaaggccggcatggacccggccgagatcgccttccagctgccccaccgggtgtttcccggcaaccgccccagcaacaccttgctctatccccgcctcgatcccttcatgctgggccagctgatcgccctttacgagcacaaggtgttcgtccagggcgtgatctggaacatctgcagcttcgaccagtggggcgtcgaactgggaaaggtcctggccaaggccatcctggccgaactgtcctcggaaaagacatccagcacgcatgattgctccaccgccggattgatcaacgccgtacggcagatgcggcaataatcggcaaataaattacagcccttgatcttgccatggcaggcccgccattttggctggcatccctgcattcgaatctgtatatgctgaacccgattgaaggtcgataccctggggaaggggctagccgcgaatgggcagcatgggacgggctgaaacgccggccgaacggcggcgcaaggggccgagattcggcgccaatttcatgacggtgctggaagtctcgcgcgaactcgtctgcctgtgtgtcgacggcgtggtggccgacgccaacagcgccggcatcgccatgctgggcgccggcagcgccgaccaggtggtgggacgcgccttccgcgatctggtgggcggcgattacgccggggtgatcgacgatctgctccatctcaaggaaatcgaggattcggcctttcccatcaaggtccgccacctggacggcggcaccttcgaggccgagctgcagattcatcccgcccgcgaattgggtccggcccacgccgtggtcaccgcccgcgacatttcccaccaaggccggctggcccgcacggcacgcgacagcgaggaccgtttccaggccctggtcgagcgctccatgcatctggtgctgctgtgccatggcggacgcatcggctatatcaacgccaccggcgtcgccgttttgggcggcaccgatcccagccagttcgccggcattccggtctcggagatctttgccggcgattaccgcgagatcgtcgccgccgatcttggcgccttgctggacgagggcggcatcatgcccatgcgcctcgcccgcctggacgggtcgaccttcgatgcccagatcaaggcgaccaaattgccgtcccagggcgccgcgccggaatacatggtcgaggcccgcgacatcaccggccagattcgggcggtggcggccttgcggcatatgaacgataccctggaacagcaggtcgccgcccggacccgcgagctggacgaggagcgcgcccgcgccgtcgaggcccgcgccttcgtggaaagcctgctggaggcggtgcccaatcccctgtggtggaaggatacccgtggccgttacctcggctataacggcgccttccgcgaactccacggcgtcggccccaccgactggatcggccgcaccactgccgaaatggtcaatcccggcttcgccgctatcgccagtcaggccgatacccaggccttggccgaggccggacgcgtccagttcgaggctcacctggaggtggcggccgaccgggcgctggacgtggtcgtcaacaagaccgtgtggcacggccgcgacaatcggcccgagggggtgatcggcgtcatgctcgacatcaccgagcgcaagcgcatggaggccgagctgcgccgcctggccactaccgacgtgctgaccggcatcttcaaccgccgccatttcatggagatggcccggatcgaggtggatcgggcgcgccgccacggccgccccctggtggcgctgatgctcgacatcgatcatttcaagcgcatcaacgacacccatggccatccggtgggcgacgtggccatcaaggcgctggccgatgtctgcacccagatcatccgccacgaggacgtgctgggccgcatgggcggcgaggaattcgccatcgtgctgaccgagaccgacctggacggcgccctgctggtggccgagcgcctgcgccaggcggtagccgccatccgcattccggccgaactgggaaccgtcgccttcaccaccagtatcggcgtcgccgagcggctggagggcgacgccaccatcgacaccatcctgtcgcgggccgacatggcgctttattccgccaagcgctcgggccgcaacaaggtggcggtgggatagccgggcaaggtaagctgccgcctatgtccatccgcctgcttccccccaccctggtcaaccagatcgccgccggcgaggtggtcgagcgtcccgcctccgccgtcaaggaactggtggagaatgccatcgatgccggcgccagccgcatcgacgtggtgctggccgagggcggccagtcgctgatcgcggtcagcgacgacggttgcggcatgagccccgacgagatgatgctggccgtggagcgccacgccacctccaagctgcccgacgatgatctggtgcgcatccgcttcctgggctttcgcggcgaggcgctgccctccatcgggtcggtggcgcgcctcacgctgaccagccgccccaggggcgccgacagcgcctggagcctgtcggtggaaggcggcgccaagggccgtcccgtccccgcagcccatccccaggggacccgcatcgaggtgcgcgacctgttctatgccacgccggcccggctgaaattcctcaaggcggcgcgcaccgagctgacccatgccgccgacgtgatcgaacgcctcggcatggcccatcccgacatcgccttttccctgtccgacggcgggcgcaaggtgctggatctggccgccaagcggggcgagccgggcgcggcgcttctgtcgcgcatcgcccaggtggtggggcgcgagttcgagcccaacgccctggcgctggacgccgagcgcgacggggtcaggctgaccggctgggccgggctgcccacctacaaccgcgccacctccgccgcccagtacctgttcgtcaacggccgcccggtcaaggaccggctggtgatcggcgcggtccggggggcctatcaggacgtcctggcccgcgaccgccatccggtggtggcgctgttcctggagcttgaccccgatcaggtggacgtcaacgtccatcccgccaaggccgaggtgcgctttcgcgattccgggctggtgcgcggcttgatcgtcggcgccatccgccatgccctggccggagccgggcaccgggccagttccaccctgaccggagtggcgctgggcgccctgggtggtggtggcggcaacagtccgccgccgtcctttgcccattatccgccgccgcgcccctccctgccgctgatccgcgccggaatcggcgcccaggcgcccctgggactggccgagcagggtctgggcctccatctgccgcccgccgcccccgtggcgccgcccgaggcgagggagggaccgggcgaagcctccgtcgactaccccctgggcgccgccaaggcccagttgcacgacacctatatcgtcgccgagaccgccgacgggctggtgatcgtcgaccagcacgccgcccatgagcggctggtgttcgagcgcctgaaactgggcctgaccgaggggcaggtggcgcgccagggcctgctgctgcccgaagtggtggatctcggcgacgccggcgccgcccgggtgaccgagcgggccggggatctggcccgcctgggcctggtgatcgactccttcggccccggcgccgtggtggtgcgcgaggtccctgccctgctgggcgacgacgacgttcagggactggtgcgcgatttggccgatgaactggccgagtggggcgcttccaccgtcctggaggagcgcctgctgcacatctgcgccaccatggcctgtcacggctcggtgcgggcgggccgccgcctctccgtccccgagatgaatgccttgctgcgccgcatggaggccacccccctgtcggggcagtgcaaccatgggcgccccacccacgtttccctcagtctcaacgacatcgagaagctgttcgggcgccgatagcccgcttgtcagccggcgcttgaccgccgtcaattaccatagctgtgcacttgggtattgtggcttcagttagacgaagtcaaggaataccgccatgagaaagaccgacagtttccgtaaacatcacgacgacctgcgggtcattgtcggccggctcgagcccatgctcgacccccagcggatcgccaccgatccggcagcggtgtccaaggtggtgctcgacctgttcggcaagttctccattcacctggccatcgaggacaacaccctgtaccccaaatgcgccgcccatgccgatgccgccctgcgccgcaccgccgccgagttccaggcggagatgggcaatctgtcgcagcgcttcgatgcctataagaagtcctgggccggtcccctggccatcggccgcgatccggcggccttcgtgacggcgacgcgcgagatcctcggcctgttcaaggcgcgggtcgagcgcgaggaaagccggctctacgacctgttcgacaaggcggcgtgagggggaaccccctcactctccgtaggagatggccaccacctcgatcatttcgaccccggacggagtgcgcaccggcacggaatccccttcggccgccttcaagagggcacgggccaccggggagatccagctgatcagccccttctccaggtcggcctcgtcgatgccgacgatggtgacggtgatctcctcgtcgcgggcattggcataggtgacggtggccccgaagaatatctggtcgcgcttcttctgctgctcgggatcgaccacatgggcggattccatgcgcttggtcaggaagcggatgcggcggtcgatctcgcgcagccgcttcttgccatagaggtagtcgccgttttccgaacggtcgccattgcccgccgcccaggacaccacctcgaccaccttggggcgctcgatcttgtgcaggtgggacagttccgcctttagcgccgcaaagccctggggtcgcatgtagttcttggcgccgggcggcaggccctggggcaggtcctcggagtcctcgtcgccgtcgctttccttggtgaaggccttgctcacgccttggctcccttcctggcagtggggtccagcggccagcgcggccgtggcgcgaaggtcagatcgtcgctttggcccaggcgcagccgttcgagacccgcccaggcgatcatggcggcgttgtcggtgcacagcttcagcggcggagccaggaattccaggcccgtttcgtttccgatccgaaccagaacctggcgcagcgccgtattggcggcgacaccgccggccaccaccagatgctgggtctggggccagcgggacttcatctcgcgcacgccgcgccgcacccggtcggccatggcatcggccaccgcatcctgaaaggcgcgggccacatcggcctgatcggcggccgacaacggctggggcaggctttcgatcagcaggcgggcggcgttcttgagccccgagaagctgaaatcgcagcccggcttgcccttcatggggcgcggcagggtaaagcgggccggatcgccaccttgggccgccgcctccaccgccgggccgccgggatagcccagcccggccatcttggccaccttatcgaaggcctcgcccgccgcgtcgtcgatggtggtgccgagacgggtgtaccggcccaccccctcgacggccagcaactggcaatggccgcccgaggccagcagcagcagatagggaaaggcgatatcgtgggtcaggcgcggcgtcagggcgtggccttccagatggttgaccgccaggaacggcttgcccgcggccagcgcgatggccttgccggtcatcacgccgacgatcacgccgccgatcaggccgggaccgccggtggccgccacggcgtccaggtcggcaaagcccacgccggcgcggcgcatggcctcggccaccagcttgtccatatgggccagatgggagcgggcggcgatttccggcaccaccccgccgaagggccggtgctcgtccagttgcgacagcaccacctcgcccagaatctcgcgccggtcgttgaccacggcggcggcggtttcatcgcaggagctttcgatacccagaacaagcactttatctgcccctcaatggcccgacaccgcccggccctttgtaaatccctttgcacagcggcgtccgacttactacaacaaccagaccatgaccgcaaaacttcccatcctccgcatcggaacccgtggctcgccgctggccctagcccagacccacgagacccgcgaccgcctcgccgccgcctgggcgcccttgggccaggaaggcgccatcgacatcgaggtcatcaagaccaccggtgatctggtgcaggaccgaccgctggccgaaatcggcggcaagggcctgttcaccaaggaactggacgaggccatgctgtcgggccgcatccatctggccgtccattccatgaaggacgtgccgacccaattgcccgacggcatcgtgctgccctgcatcctgccgcgtgaagacgtgcgcgacgccttcctcagcctgaaggtggggtccctggccgaactgccccaaggcgcggtggtgggaacctcgtccctgcgccgcggcgcccagatcctgcaccggcgtcccgacctcaaggtggtgaacttccgcggcaacgtccagacccggctgcgcaagctggaagagggcgtggtggacgccaccatgctggccatggccggtctgcggcgcctggggctggcccagcacgctacctcggccctgtccgaggacgacatgctgcccgccgtggcccaaggcgccatcggcatcacctgccgcgccgacgatcaggcctcgctggattatctggcggcactcaactgccccgattccttcgtccgcgtcgcggcggagcgggctttcctcacccgtctcgacggttcgtgccgcacccccatcgccgccctggccgagctggacggcgaccgcctgtccttccgcggcctgatcgtcagccctgacggcaccacggtccacgccacggcacgcagcggcagtcgggccgatgccgaagccatgggcaaggacgccgccgaggagctgatcaaggtcgccgggccgggcttcttcgacctgatcaagccgcactgaaccatgcgagccctcgtcacgcgaccgaaggaggattccgagggcgtggcgcaggcactgaagcagcgcggcctcgacgtcatggtcgagccgctgctcgacatcgccccggtggagggcgccaagcccgatctcggcggcgcccagggcatcctggtgaccagtgccaacggcattcgcgccctgggccgcctcacccccggccgggagcttcccgtctgggccgtgggcgacgcctcggcccgcgccgcgcgcgaaatggggttcacccgcgtggaaagcgccggtggcgacgtggagaccctggccgagctggtggcggcccgcgtcgacccccagggcggcgccctgctgcatgccgccggaacggtgacggccggggatctgtcggggcgcttgtcggcgctgggattccaggtgcggcggcaggtcctttatcgggcggtgaccgccacccgcctgtccgacgggctgcgggacgcgctgcggaacggccaactgcatctggctctgtttttctctccccgcaccgccaggacctttgctaccttggcggttgaggcgggggtgcgggacagtctcgccgccatcgccgcctatggcctgtcggccaatgtctcggccgagcttggcccgctgccctggcgggtgctgcgccaggccgccgaacctacccaggcggctctgctggccgccatcgacgacgacctcaaccggggattcagcccatgacgtcagagcctgcttccgagcccgccgcccccgtggaggcgccgacccagggagcgccgaagaaatcgtcgggccgcctgatcgccgtactggccgtcctcgccctgggcggcggcgcctatgggacgttccccctgtggcgggacctgctggggctgccatccgccccggcctccgaatccttcgaggtcgagaacctgcgggcggaattggcggcggctaccaaccgcatcgcccagctggaagccaagccccccgccgacggcagcgacgccgcccgcctcgaccggctggaagaagccctgaaatccgccccggcccgcgccgccgcccccatcgccgagatcgaatcgatctcgaaacaactggccgatctcaagcgttattccgccgaagccagcgccgtgctgcgtctggccgaacgtctggagcaactggatctggccgtgcgcgacttgcaggccaagcgctcatcggccgccgctctgctgctggcggtggggcagttgcgcgaagcggtggcggctggacggcccttcgattccgaatggcgcgccgcccgcgtcctggcgggcgaagacacggaaagcctggggctgctggaccagattaagccgcaggcgggcgagggcatcgccccccgcgccgccctggtgcaaagcttcgacgtcctggcccccgccctgatccgcgccgagatcctgcccgagggtgatggctggtggcggcgcaccgccgaccggctgctgtccctggtcaccatccgccgcgaggatggtgccgccgtgggcgccaatgccgccgccgtggtcggccgcgcccaggccgccgtaagccgtggagatctggccgccgccctggccgaacttgacgccctgagccccggcccggcccaggccgccgctccctggatcgccgccgccaaggcccgccagggcgccgacaaggccctgtcgcagatgaccgcccaagcggtggccttggccggatcgggcgtgagggttgggccatgaggcggtttctcgtcttcgtcgtcctcaccgggctggcggtggccggcgccgtctggctggccgaccggccgggcgaggtgaccatccgctggcaaggctggcgcctggacaccaccgtacccgtgctgctcgccgtcctggcgctgctgctggtggggctgtcgctgctggcccgtctggtgcgggcggtgttcggcgcccccggccgctggctgcagtcgcggcgtttgggccgtcagcgcaagggctacatggccttgtccgacgggctggccgccgccgcctcgggcgacgcggcccgcgccgccaagctgtcgcgcaaggccgacaagctgctgaaggacccggcggtcaccgcgctgctcaccacccaggcggctcagttgggcggtgacgcggaccagctccgcgaccgcttccgcgccatgaccgggcgcaaggaaaccgccttcctgggccataagggtctggccgaactggccctgaaatccggtgatcgggccatcgcccgcgacgaggcggccagggccttcgagctgcagccgatggccgccgatctggccgtccagctgctcgacctgcatgtggaagccggcgcctgggccgaagccgagcaggtgctgcgcctggcgcggcgccatggcgcggtctcggaggccgacttcccccgccgccacgccctgatcctgctgggccgcgccgaagaggcgctgcgggccggcgacgaatccttggccctggactgggcgcaggacgcccgcgacgccgacccgctgttcaccccggccatcaccctggccgccgacctgctgcgccgccggggcaaggggcgcaaggccgcgtccctgctgaaggccgccttcaaggcccatccccatccgctgctgatcaccgaatggcgcaagctgggcgacggcgaaagcgccctggaccgggtcaagagcctgcaggagctggcccaggccaacccaggcgcccccgagggccatatggccctggctgaagctgccctcgatgcccagttgtgggggctggcccggacccatctggccaaggcccaggagcagcgccccacccgcgccgtcttcgccctgttggcccgcgtcgaacgcgacgagcgcaaggacgaggccgccgccaatgcctggaccctgaaggccgcgaccgattcggtcccggaatcgtcctggacctgcggtggctgcggccaccagacccctgacttcgccctgagctgtccggcctgcggggccgccggccgactggagtggacatgacgccctacgccgtgctcgccgccgtcctggcggctctttgcgcctctcccgccctggccgcccccagcccggccaccgacggcaaggcgctgttcgccgccaagggctgccaggcctgccacggcgaggcgggggccaagcccatcgccggatcgcccgtcatcgccgggcagaacgccatctatctggcgcggcagatgaccgagatcgccgacggcacccgcacctcggctccggtcaaggtgatgaagccgatcatcgaaaagaccacccccgacgagcgcaaggccctggccgaatggctttcgacgcaaaagccggccgacccgcaaacgggcgacaaggccaaggccgagcagggcgccgagctgttcgacgagaacggctgcatcggctgccacggcgccgacgggctgaagccgctggccgactatcccttcctcgccgcccagcgcaaggactacctgatgatccagatcaaggccatccgcgacgaaatccgctcgacgcggcgcacccgcatgatgaccgccaatgtccgcaagttctccgatgcccaggtggagcaggtggcggagttcctttcgcagaccaaacggaaataggcggccgggatgagcttgcatccgcttcccgcctccaccctggttttgggcggcgcccggtcgggcaaatcggcctttgccgaatccctgttcggcgacagccccgccctctatctcgccaccggccaggccctggacggcgagatggccgagcgcatcgatcaccaccgccgccgccgcggccccagctggagcaccctggaggagcccctggatctggccgaggcgctggacaacgtcctgaggcccgaccggccggtgctggtggactgcctgaccatgtggctgtccaacctgatgcatgccgggcgcgacatcgaccgctcgctgggccatctatgcgaagtcctggccgagcccgccggaccggtggtgatggtctccaacgaagtgggcatgggtctggtgcccgagaccagcctgggccgccagttccgcgaccaccagggccgcgtcaaccagcgggtcgccgcccaatgccgcaaggtggtgtttgtcgccgccggccttcctttggttctcaaggatattccctgatgcgcaaggttcccgctaccgtcatcaccggctttctcggcgccggcaagaccaccctggtccgccacctgctggaacataaccagggacggcgcatcgcgctgatcgtcaacgagttcggcgatatcggcgtggacggccagttgctggccgcctgcggcgtggcgggctgcacggacgacgacatcatcgagctggccaatggctgcctgtgctgcaccgtggccgacgagttcctgcccaccatgcaggccttgctcgaccgccccaacccgcccgaccatatcgtcatcgagacatcgggcctggccctgcccaagccgctggtcaaggccttccactggccggagatccgctcgcgcgtcaccgtcgacggcgtggtggcggtggtggattccccggccgccgccgcgggacgctttgcctcgacgcctgaggagatggcccggcccgatcacgacaaccccctcgaggaagtgttcgaggaccagttggcctgtgccgacctgatcttgctgaacaagtccgacctgctggaggccgccgccctggaagccctgcgcagcggcatcgccgcccgcctgcgccccggcgtcaagaccctgcccacccgcatgtcagcggtggacccgctggtggtcctgggcctgtcggccgccgccgaggaggatctggccgcccggccatcccatcacgacgccgaggacggccacgatcacgacgatttcgagagcttcgccgtcttcctgcccatggtcgacgacccggccgtggtcgaggcccgcgccatcgccgccatcgccgaccacgatatcctgcgcctgaagggcttcctggcagtgaccggcaagccggcccgccacgtgatccaggccgtcggtacgagagtggaacgatacttcgaccgcccgtggaaagcggatgaggagcgcgtcggcaccctggtggtgatcggccgcaccggcctcgaccgccagcggatcgaggccgcgcttcagggtctctgatgcatcttctcgccacccaggccggaaccatctccgacggcaccgaggccatcgatcttggccagagccccgccgacatggtggtgctgtccgccgccgacacggaactggcggcgctggccgccgccttcggggcctggagcgacgcgccgtttagcctgcgtctggccaatctcacccgcctcgcccaccacatgtcggtggacctctatgtggagcaggtggtggccaaggcccggctggtggtggtgcgcctgctgggcgggcgctcctactggccttacggtatcgagcagatcgcaagcgcctgccgccgcaacggtgtcgccctggccctgctgcccggcgccgaccagcccgaccccgatcttgccgccgattccaccctggcccccgaggcgatcgagcgcctgtgggcctatctgctgcatggcgggccggataattgccgctcgttcctggcctatggcgccagcctgatcgggcatccggccgagtggctggaaccccggcccctgccccaggccggtctttatggcgattccgatccacgcgatgggcgcccccgcgccctggtggtgttttaccgcgccctggtgctggccggcgacaccgccccggtggatgctctgctggcgggcctgcgcgggcaggggctggcggcctcggccctgttcgtccacagcctgaaggacccggtcagcgccgcgctgacccgcaccctgctggccgagacgccgcccgatgtcatcgtcaacgccaccggcttcgccgtctcgtcgccgggccgggcggaaagcactccgttcgacgccgccgattgcccggtgctccaggtcatcctggcggcgggcacgcgggaggcctgggcggcgggcaaccaggggctggggccgcgcgacatcgccatgaacgtggcgctgcccgaggtggacggacgcatcatcacccgcgccgtctcgttcaagcaggcccggcgcgacgaggccacccagtgcgatctcgccacccatggcccggtggcggaccgaatcgaccatgtggcgaagctggccgccaattgggcgcggctgcgccgcaaagccccgtccgagcgccgggtcgccctggtgctggccaattatcccaaccgcgacgggcgcatcggcaacggtgtcggcctcgacaccccggccggaacggtgcgggtgctggaagccctggccgaggcgggctatggcgtcaccaacatccccgggagcggcaacgccctgatcgagctgatgcaggcgggcgccaccaatgactggcgcgccctggcccatcgcgagcggcgcgaaaccttgtccctgcccgattacctcgcctggttccagtcccagccccgatccctgcaggacaaggtcacggcgcgctggggcgcccccgaggccgatcccttcttcgccaagggtgaactcacctgcggcgacttcatcctgccggcctcccgtttcggtctcgttacggtcgcggtgcagccggcgcgcggctacaacatcgacccgtccagctcctatcacgatcccgatctggtgccgccccacaactacctggccttccatgcctggatccaggacggtttcagggccgacgccgtggtgcatatgggcaagcacggcaatctggaatggctgccgggcaaggccctggccctgtcggccgagtgcttcccagaggccgcgctggggccgctgccccacctttaccccttcatcgtcaacgatccgggcgagggcacccaggccaagcggcgggcggcggcggtgatcatcgaccacctgactccgccgctgacccgtgccgagagctacggccccctgcgcgagttggagcgtctggtggacgagtattacgaagcggcgggcgtcgacccccgccgtctgacgatgctgcgccgcgagatcctgaccctgtcggccgccaccgggctggatgccgatctgggcatcagccgcaacgacgcccccgacgaggccttgaaaaagctcgacaatcatctgtgcgagctgaaggaactgcagatccgcgacggcctgcatatcttcggcctgtcccctgcgggagaccagttgaccgatctgctggtggccctggcccgggtcccgcgaggcgccgccgccgaggccgcctcgctgccccgggcgctggccgccgatctggggctcgacggcttcgatcccctggattgcacccccggcgagccctggaccggcccccggccggatgccctgggcggcgaatccccctggcgaagccatggcgatacggtcgagcgcctggaagccctgtcccgcgccctgatcgccggggaaagactccccgaaccgggatggacaaggaccattccggttttgcaatggatcgacggccacctgcgtcccgtggttcagtgctgcggccaggccgagatcgaggggctgctgacgggccttgccggatgcttcgtcgcccccggcccgtccggtgcccccaccagggggcggcccgacgtgctgcccaccgggcgcaacttctattccgtcgacactcgggcggtgcccacgccggcggcctggagcctggggtggaaatcggcgcaattgctgttggagcgccatctgcaggagcacggcgactggccccgcgccctggccctgaccgcctggggcacctcgaacatgcgcaccggcggtgacgacatcgcccaggccctcgccctgttgggggtcaagccccgctgggacgtgggctccaaccgggtggccggcttcgagatcctgccggccacggtgctggatcgcccccgaatcgatgtgaccttgcgcgtctccggcttcttccgcgacgcctttcccaacctgatcgacctgttcgattcggcgtctcgcgccgttgctgccctggacgagcccgccgacatcaaccccttggccgcccgggtccaggccgagcggacccggctggaggccgagggcgcctcggcggagcaggcggcgcggcaggcgggctttcgcgtgttcggctccatgccgggagcctacggcgccgggttgcaggccctgatcgacgaaaagggctgggccacccgcgccgatctggccgaatcctacatcgcctggggcggctgggcctatggcgccggaacggaaggcgaggccgggcacaccctgttccgccagcgcctgtccagggtcgaggcggtagtgcacaaccaggacaaccgcgagcacgatctgctggattccgacgattactaccagttcgagggcggcctggcggcggcggtggagaccgcttcgggcacggcgcccaccatctggcacgcggaccattcccgccccgaatcaccccgcatccgcaccctggacgacgagatcgcccgggtggtccgcgcccgggtggtcaatcccaagtggattcagggcgtcatgcgccacggctacaagggcgccttcgagatggcggccagcgtcgattacctgttcgccttcgccgccaccaccaaggcagtcaaggaccaccatttcgatctggtggccgaggcctatctgggtgacgaggcggtgctggacttcctcaaggccaacaaccccgccgccctggccgagatccgcgcccggctcaacgaggccatccagcgcggcctgtggcacccgcggcgcaattcctcgtatcgactgctggagtccgacccgccatgctgaccccccgcgccctgattctcgccgccctggccttcgccggcacggttggcggctacctgctgtcgcggggcatgctccactggcccaagggctgaggcggtgtcggaaccaatcatagatcggactgagaggcgctgaaaggccgctatttaggcctttcagccggagccggtgagctactccccggaaattggacactgacggaagctacgatctgatgtttgctgatccccaactacgaggagatcagagatgtcgaagcgcaggaaccatgacgcggccttcaaggcgcgtgtcgcccttgaggcgctgaagggcgagcggacggtatcggaattggcgtcggcctatggcgtccatccgaccatgatccatcaatggaagaagtccctgctggacggggcggcggagatcttcgaacgcggggccaagaagaaggccgaggtggacgaggatacggtgcgatccctgcacgccaagatcggggagctggccgtggccaacgattttttgtctcgaaagctcaagccgtggaccggcaagtgaggcggaccatgatcgagcccaaacacccggcgctgtcgatcggcgcccagtgccacctgctgtccattgcgcgatcatcgttctattacgagcccttgggcgagacggaggcaaacctggagctgatgcggttgatcgaccgccaattcctggaaacgccgttctatggtgtccgtcagatggcttggcatctccagaacgagggccacccggtcaacgtcaagcgcgtccggcggctgatgcggctcatgggcctgatgccgatctaccagaagcccaacaccagcaagcccgccaagggccacaagacctatccctacctgctgcggggcctgcggatcgaccggcccaatcaggtctggtgcgccgacatcacctatctgcccatgcgccggggattcctttatctgatcgccatcatggactgggccacccggaaagtgctggcctggcgcatctccaacacgctcgaggccgacttctgcgtcgaggtgctcaacgaggccatcctgcgcttcggcccgccggagatcatgaacaccgaccagggcagccagtttacatccttcgcctggatcgaccggctgaagcaggccggaacccgcatctccatggacggcaagggccgttgcatcgacaacgtctttatcgagcgcctgtggcggtccctaaaatacgaatgcgtctatctccatgcctgggaaaccggctcgcaagcaagggccgggatcggaccctggatcaccttctacaaccacaaacggccccacgccgcccatggcggaaggacccccgccgtggtctactggaataccatcaaccaaaccgatcagcaggcccggagagtagcttaaacttccccgaattctgtccaaccaatggggagtagctcaaacttcgatagagggggacgttttgcgtaaacttgttattgcatctctggctgtgctgagcgcctgcgcgactccatccacttatgagttgaagtggagggcggaacggaacttcgacaaattcgccgatgggccgacatgccgcgtgagcatatgggggaattggtcgggctccctattcccccaccagttcgccggcatgatctatcctgttgtggaaatgcggggtgacctggtgctggtgggagccaagagcgttcccatgggtaatgctatggctcaattccaaatgccggttggcgacattcaactgaggatcgacggcaacaaagcttggactgttgcagcaatcaacacccccagcctagctcccgagggaaactccaaggagatcggggcacagaaggttgcaaactcggcgtcaccatcaccctatctggacccgaaggctatggccgagatgacccagaacatgatgagcacctaccgcagcggcatgtcaccaatcaccgcgacaagcggcgacaccgccaaggacatcctcaggcagatggctaccggcaggacgatattgttccgccaggttaacggcaatgctgccgggaagacgttcgagtattccctggaaaccttcaattctgccatggcggcatgcgcatcctgaaaagccggcccccgatttgacagactcaacagaatgttagaagcttagccctggtctgtgcggctaacgatccgcgtatatatatgcatctcgtcttgacgccccccttggggggctagggcggtatcgtatgtgtgcgcggacctcgaataacaaatcgaggaaagccgtacccatgcccctgtctcctgaactctcatacgacgcccacatcgcccccattctggtcggcacccacgccccaggattgccctcatacatcattgcaattcaacgatttattgcccgcctcgactttccggccaaagccaccaggcgtgcggcctccatagtagcatccctccaagaccgtctctcctcccgcctggcaggtaagcttcagagatggaaagacctgggggatgcggagaagctcctctacatcgtcatcggattggagcagatgaacttcaggttcaacgccttcgccaccatccacctgaaggaggccggcaacgagatcgagacagccgaacaggtggtcgccgatcttcaagaggtgctccggcatgttgaccccatggccgaggtgctggcggtcgaggcgcttgatcgaggtatccggcatgtccactgcctggtctcgctgccgaaggctccaaccacccgtgctggccgtgcccacctccgcgatatcgtcggctggttcgatgagcgcaatggccggccaggcatcgcctggaagaatggcagcggcgttcccgcccatctcgaatggctggacgagcagaaggtcttccagcgcgtcggcgttggcggtctcgtgggggcggcctgctacatggctggccagcgtgagatgcgcttggtcgccggtcggaacctacgcgccatcggcaagcggcttcatgccgacgcgacggagggcgtgcgccaggcgcgtagtccgggtagccagttcagtctcgatgccgagaccgagtgtgaggcgcctctagccggcagatcgggcgagagcgagatggttgaagatatctcacgactgacctctgctaagttcgatctgattgaactgacccggcaggaatgggcacggagttggtggcgcgttccgccctgcattgagcgcccggccctgctgccggcaagatagcgcacttagcttgcatcccagaccatcaaactggggtgaagctcagcattgcttccttaaacgactcgtagcctgcctgtccgtcggacccgacggcattcttcaacgagccatcgcatcccttcgcggcgaccagccgctccctgacgtgctcgtatcccttcgcctcgcagatggccagcaggcagtgctcgaaggtcacgactaccggcttgagccggccgaattcgccagggaaggcatctgccatggcggccaggaaccgcttgtcaccggtgaccaatttgttgtcgtgctcgcaatgaagggcgaccagcgcaatctcagcctcgccggagtcgatgccttcatggaaaatcatcttgttgtagagatcggtggtgaccaccgcttcgacccagcctttgggcatcaccggcacctgttcggccatcttttgaaggcgttcggtaacagcggcacggagggcatcgtctacggccatgcgtcggagggccgtcttcgatcccaacgcagtagccgaggccagtcgataagggtgggtgacgccgagcacttcaagcgcttcctcccacaaatcgcagcaggccagcttgatgaagacatccttgtcgaagaacgcgtgaagttcccccatcaaccccaccgtcacaagaggccgatacgttccaggaattcgaggctatcgtcggacagagcgtccatatcgatgttccgcctcatggcctcgcggcacatgtctgcggtggggacattttcgccgatatgcttcagagccgcgttggcgagaggaaacggatgtttgccgttgaagactgaattgctggccgcattcaggatgacgtgacctggatcgatgccgactttgaagccgaattcgacagctgttctgccaagctccgctgggggcatcgggtgcttgagggagatatttcccttcttgccgccggtcaggagctgcaaagcatatgtgttcgcggccttttcctgatcgtcggtatcagtatccccctccgacaccttctcatcaacgatggcttctccctcgcattggtcgaggtgcccttcggcaatatggcccatctcgtgagcgagcacgaacagcatccatgctggggctgtcgccttcttggtgaccaggatcactggccgaccgccgcagaaggtcaccatgccctccattttcgacttggtgacgggcagactgggcatatagacgaccggtacaccgttggaccagcaggcatccagcaggtcatctagccccacccagggggtattcccgtgagtgatagcggtggcgcggagggttgcggcggacggaagcgaaccggaccatgacacggtggtggccgacgcaacaaccttggccacggcggtcgccaaggcgcgagcagagacgatctccgaaatgtcggtgccggttcgtgtcttgaagcaggcatggggcatatgacgctggcgcagacgaccgtcggggccgatctcaaggccaaagtgcttggccacaaagccacgcacctcgaagacaccggacgggtgcgcgacagcctcctcccaccattcgggtaaggtctggaaggcgtccttgggcttcagtccggcggcggaaaattctcgctgaagcagcttcttcgggtcgatgggggaaacgcggcttgcgacggtcatggctcacctctcccactcaacgacgcccagaacacagcgcctctataacatggtgagagaagcacgtgaagcctaccctatcgtccgcgcatgagtgccgccgtgatcccctcgtaggcaatcgctgaaatagcctcgtgccaatccttgatgacgaagcccttgccgtatcgtccccgctccaccggagtgtcatggccgtccagttggtccatcaggtcgggatggaccttcgcccgttggagggcggtgatgaccgaatgccgtagcgaatggtaggacacgccggtaatgcccagtgagcggatgtaatcggggaaccatttgctgaacaggtatccgaagcgcattgccgtaccaccaggctcaaggtcgggaaataccatcttctcgttactgtccagtagcccggcgacataatcgaggaaccccaactccaccaggatgggatgcagggggatacgccgccagccggcagcggttttcaccttgcgcttggggaggtctgctccctcctcgtcttctgtcgcatgcacatggagaaagggaatgcccccgtcctcctgcacgtcctccagccgtagttgggccacctcctccagccggatcgggtggaaggcacccagcagcggcagccaataccgcgcattccgaaggagatgcggaccagaacgcggcttggtgcggaaccgagttgatgctgccccatggtataggggacttgagaacagcaaccggagctgttccggtgtccaggcggcacgctcctcgctgcggcgataggtgcgcttccacttgaaagcgcctctcgccaggttagcctccagtccgtgctcatcgacgcaccagccgaagaaggtgctgatgatgccggtatggcgcttgacggtcggcggtgcgagggtcttgatcttcgcatccttctctgccatcgccaccagctccgaaagcggctttccggtcagtgcaggcaccttgccccgcatgcggggcagcccttgcagcatggtggcgaagtcggtgaagtcggtgcgctcgtagcgatctatccgccggtcgccgcaccattccttgaacagttcgcgggcatctacgttggccttggcctggtccggcccccagctcttggccttggctcggctgtagcgggtgaacgcttcactgagcttgggcagagccttcttgcgagaagtcgcctgagagccggcctgcaccgcgaacagcgggtccatgggggctaccgtgtagtcgccctccagacgggcggcctggacccgattgaggtcagccacggcacgcaagagcccccggcatacccgcgtataggtatcgctgccttgcaaggcttggatgccagcctgagcgaacagttcgtcggccaactcctcgacgagaaatgtccggtcgtgcttcacgccgtccgcatagtcggtggccatctgctttgcggcgcccacgcagacgggcatgttgccaaacccgcgcatctcctcccagtgctccagggcaccggcataccactcacgcagcaggtcgttgatttgtgcggtggttaggtcagggcgtcgcttcaccatcagaaacagctcatccgtcaatgtcgttagccgcctggccttctcgcgagcttcggcataggaaagcacgccgaggctcttgaccaattcgatgcggccgaacctgccggcgagagaaggggggatgcggcgacgccaatcatatcgaccgccgcgaattcgcaaatagtaacatcttaccattgaatgcctcgctgcgacccacgaggcgcagggcagcgggcgccttgtggaccgtcgtggtggagacgggccacaggggcggttcgacgcctgaaaaatgctaactaattgaaatagataggaaacgcttggctggggcgccaggattcgaacctgggaatgccggtaccaaaaaccggtgccttaccgcttggcgacgccccaccagcgcgggcgggcaacatagcccgagccgcgacgactttcaacggcctcaagacagcaattgcgccggagcgatccaccaggcgggatgggcggcgccaagttgggcggcggcggcgcgggcctgggcttcttcggcatacaacccgaagcaggtggcgcccgaaccggacatgcggggcagcaggcaatcggcggtcgcggcgatggccgccagcacttcgcccaccaccggctcgatggtgatggccggcggggtcaggtcgttgcgccgcgccgccagggcctcggccagacccttggcgtcacggggcggggcggtcagcgggtcggcggccgagaatgggccggtacgcgccttgaacaccggcggcgtgtgcagcggcaccaggggattgaccagaaccagccaggcgggcggcagggtgggagcgggctcgagcacctcgcccacccccatcatgcgcatgggggttccggccaggcagaccggcacgtcggcgccgatggacaaggcgacccggcgcagggtctcggccgggggagcgacgccccacagccgcatcagacccttcagcgccgccgcggcatccgccgagccgccgccgatgccggcggccaccggcaggcgcttggtcagccggatggcggcgcccttggtcacgccagtggcttcggccagcaggcgggcggccttcagcacgatattctcgccgtccggaatctggctggcggtgggaccggtgacctcgagactcagggtctcggccgggctgaactccagggtgtcgccgatgccggcgaagaccaccagggagtccagcaggtgatagccgtcgtcgcgcttgccgaccacgtgaagggtcaggttgaccttggccggagcctcgatcgagaagctggtcatgatgaatccgtcgcttatttgaccggggtgccgggcaggcgcccggtggagatcttggccttcagcggctcgatctgctcgggctcggggtcgaggcccatggcccgctgccactggtagcgggcttcggtgtcgcggcccacctgccagaaggcgtcgcctagatgctcgttgactgtgggatcctcgggcttgagctcggaggcgcgctcgagatacttcaccgccgcctggaactctcccatgcgatacagcgcccagcccagggaatcgacgatggccccgtcattgggacgcagctcgacggcgcgctcgatcagcttgcgccccttctccacattgatgccctgatccacccaggtatagcccagatagttgagcacgtcgggctgatcggggctgagacgcaacgcctccagcatgtcgggctcggccttggaccattgcttggcccgttcataggcgatgccgcgggcgtagaacagcgaccagttgcgcgcatcctggcttccgccgttgcgggccagggcggcgccataggcgtcggcggcctcggcatagcgcttgtgacgacgcagcacgtcgcccatggtcatcagcgcctcgggcgattcgggccattccgccgccagggacgtcagttcggagagggcggcatcggtctgcttcatctcgtccaggttcaccgccagcttgagccgggcgaaggctcccggctggctggcgcggttcatggcgctgtaaagggcgttggcctcgtccagccgtccctgggccaccatggcgtcggccagcagcagctgggccagggggaaatcggcccgcaggctgagcgccaggcgcgagaacaccagcgacaattcctgggcattgccctggcgcaccagcgaagaggtgtcgaacaaggcctcggccaagccgtcacgggcggtctccaccacgcggggcaggttggtccccgccgccagctggcggcgcccgtccagcagcgagcggtcggcatgttcggcgtgatagcgctcgtacagcgccttggcctcgtccatgcggccggagcgctggtaccaggtccctgccgcctccacggtgcgcacgctggtctggttggccagggccgccttgaaatgcgcctcggccacgtcggggcgcccggccagatcgcccatcaggccggcatggtattcccagacgggagcgaagccggcggtatcggcgcgcggcgccagggtggcgaggccgtcgtcgaactggccctgcccggcgcgggcccaggcggtgagcagcggcccgagaaaaccgttgatgcccttggccggcaaggcggagaagcgcttttccgccagatcgaaccggccggcgcgggcgtcctgcacgcccatcaccagaaggggcaggggagaatcgtcgtcgatgaccagcaggcggcgggcgatgggctcggcctcgtccaggcggccctcggccagcagcagggcgaagctgcgctgctggatgtcgatgttgtcgggatcgcgccgggcggcggcggcgtaatattccgcggcggcgcgggtgtcgccgcgcgcatgggcgaagcgcccggccagataggcccccaggcccgtctcgttgccgctgccggcattgtcatcggcggaagcatcgggccgcggggcacaggcccccagaccggccgcaaccatcgccgccatcaccacgatcccgaaacgcttcacgcccaacaccttatgacaggaaccggggcgcccgattgtgccgggcgccccacggaactccgatcactcagtcttacatgttggggtagttcggtccaccgccaccttcgggaaccacccaattgatgttctgggtggggtccttgatgtcgcaggtcttgcagtgcaggcagttctgcgcgttgatctgcagccgcggattggagccatcgtcgttccggacgatctcgtagacgccggccgggcagtagcgctgttccggggcgtcgtaatgttcgagattgatggcgacgggcaccgccggatcgcgcagcttgaggtgggccggctggttttcctcgtgattggtcgaggaaatgaacaccgaggacagcttgtcgaagctcaccaccccgtcgggcttgggataggcgatcttcgggcattcgctggccttcttcagcgccagatgatcgggctggtggtggagcgtccagggcatcttgccacggaacacataggtctccagcgccgaataggcgatgccgccccacaggccccagtggaagctgggacggatgttgcggacggtgtgcagctcggaccacacccagctcttcttcagatgctcgggataggtgaccacctcgttggcgccgccctcgtggcccagggcctcggccaccgcctcggcggcgaccatggccgacttcatggcggtgtgggtgcccttgatcttgggcacgttgaggaagcccgccgtgtcgcccaccagcacgccgcccgggaaggtcagcttggggatggactggaagccgccttccgacagggcgcgggcgccataggacacccggcggccgccttcgaacagaggacggatggccggatgggtcttgaagcgctggaactcgtcgaagggcgacagatgcgggttggcgtagtccaggccgaccacgaagcccaccgccacctggttgttctccaggtgatagaggaacgagccgccataggtctggctatccagcggccagcccacggtgtggaggatggtgccggccttgtgcttggccggatcgatctcccacagctccttgatgccgatgccgtaggtctggtcctcgcaatccttgcgcaggtcgaagcgatcaaacagcgtcttggtcagcgagccgcggcagccctcggcgaagatggtctggcgcgcccacagctcgacgcccggcgtgtgattgtgggtgggctggccatccttgccgatgcccatgtcgccggtggccacgcccttgaccgagccgtcctcgttgtaaaggacctcggcggcggcgaagccggcgaagatctccacgcccagggcctcggcctgacttcccagccagcgggtgaaattgccgagcgagacgatgtaattgccgtggttgttcatctgcggcggagtcatcaggcggatggccttggactccgtcaggaacatgaagcggtcgtcggtggccggcgtcagcagcggcgcctcgcgctccttccagtcgggaaacagctccgccagggcgcgggtctcgatcaccgcgcccgacaggatgtgggcgccgacttcagagcccttctccagaacgcagacattgaggtcggcgttgatctgcttcagccggatggccgcggtcaggcccgaaggcccgccgccaaccaccacgacgtcgaattccatggattcacgttccataacgtcagctactccccttgcgccacccgttccaccggtcgacgcccgacacggacttaggcgcttctatagcacacccatcgggatcgattcgattccttatggccatgtttaaggaaagaatgtgtctcaaatatttccccgccatttgccagggctgctaaaatcgcccccatgaccgccatttccgccgatctcaacccctacgacatcctgcgctggtacctggaatccggcgtggacgagaccatgggcgaggagcccctggaccgctacgccaccacccgtcgggccctggaaagccgtgccgccgccgtgccgccgccggcgccgcaagcccagcgccagccccgtccgcacgccgagcccatggccgcgccgcccggcgcgctttcggcctcggccttgcccggcaccgccgctcatctggcggccggctgcgccgacctacaggcgctgcgccatgccatggaggggttcgaggggctgcagctcaagcaggcggccagttccaccgtgttcggcgacggcaatcccgagtcggcggtcatgtgcataggcgaggcgccgggccaggaggaggaccggcgcggcctgcccttcgtgggacccagcggcaagctgctcgaccgcatgctgggctccatcggcctggaccggagcacctgctacatcaccaacgtggtaccctggcgcccgccggccaaccgcaagcccacccccgacgaggtggcggtgtgcatgccgttcctcacccgccatatcgagctggtggacccccaggtgctgatcctgctgggcggcgcgtccgccgcggcagtgctggccaaggccgacggcatcaaccgcctgcgcggccgctggttcgagttcaactcgcccggcctgccccggcccattccggcgctggccaccttccaccccgcctatctgctgcgcacccccgaagccaagcgcgacgcctggcgcgacctgctgatgatccggcggcggatggatgccgtacggcattgaattgacggcccggcaatcctcgtcccactatgaccgcgtcgcggcggctaaaggaacggattgcatggccggtgggctcggcaagcggggaaccgtctggcaatggaaagggcgtctgttcaccgtctgcctgatggtggtgatcggatcgctgtggggcggacaggcgtggctcaaccatagccttgccctggccgatgccgagaacctggcggtctcgctggcccgctcgctgcaataccaggtccatggcagcctgcggggcgtcgaggcgctgctgaacgaggtggccgacagcctggaatccgggcacggactgaccccggtccagcgggaacgctatcgcggccgtctggccggatcgcctgaaatccgcaatctggtagtggccgatgccgatggccgggtgaccgacatatcggtggcccagcccggcgaggccatatcgcacggcatcggcacggtcggcgaccgcgactacttccaggccctgcgcactggcgggacaagccgccctctggtgatcggcgcgcccgtcgtcagtcgcttctcggggcaatccagcatcccggtggcccgggcgatcttccgtggcgacaactcctttgccggaatcgtggtggcgggaatcgacccccgagaattccgcgagcagatcgaatcggtggcggtcgagccggaaggcggcgccgccctgatccgctccgatggcattttcctggcgcgggtgccccgtcacgacgaatatatcggccgctcggtggccacctcgccgctgtttcgggaccatctgtcgcgctcaccctccggcatcgctcatttcgtgtcggtcgccgacggcaacgacaagatcgtcgccttcgagactctgaccaattatccgctggtggtgacggtggggatcaccagccggaccgccctggcccgctggaagcgccagaccacgatcgaggccatggtgctggcggtgctggcggcgtccctgctgatggtggccaccctctatgacctgcgcgtcgccctgagtcggcgcctgaccgagcaattggcggccagccacgacgaactcgagcgtcaggtcgaggagcgcaccgcccatcttgccgcctccaacgccgagctggagcgcttcgcctacgtcgcctcccatgacctgaaggagccgctgcgctcggtctcgggcttcctgcaactgcttgatcgccgctaccgcgacaagctggacgccgaggggcacgaattcatcgagttcgccgtcaacgccgccaagcggtcatcggcgcagatcgacgacctgctggccttctcccgcgtcgggcggctggatggcccgccggaatgctgcgattccggcgccttggcccggggtgcgctggaaagcctggctccggccatggacggcctggaggccgacgtggccatcggagacctgccgccggtctggggccgccccgcccagctgcaaagcgtgtttcagaacctgatcggcaatgccgtcaagtaccacgccgaaggccgcccgccccgcgtggacgtgcgggccgagagggattccgacggcatgatccgcttttccgtcgcggacaacggcatcggcatcgaggcgcaataccacgagcgggtgttcggcatcttccagcgcctgcatcccatcggccgctatcccggcaccggcatcggcctggccatgtgccgcaagatcatccagcgccacgggggccgcatttggctggactcgcgcccgggggccggaaccaccgtgttcttcaccttgaaacacgccgatggcgacgcacccaggctccaagcgtcggcccaataagattcccacgttgcacgcctcccataccgccctatataacgccgatgggacggatttgggtcgttccctaacgtttgatggatgcaacccgaatggggatctcaatggccggctgctgaagcttcagggccgccgggatctgccgaacaggaaagaggacagtcatgagcaaggttatcggcatcgacctgggcaccacgaattcgtgcgtcgccgtgatggaaggcaagaacgccaaggtcatcgagaacgccgaaggcatgcggaccaccccgtccatgacggcgttcaccgaatccggcgagcgtctggtcggtcagccggccaagcgccaggcggtgaccaatcccaccagcaccctgttcgccatcaagcgcctgatcggccgccgcttcgaggacccgatcaccaagaaggacatgaacctggtcccctaccacatcgtggcgggcgacaacggcgacgcctgggtcgaggcccgcgacgccaagtacagccccagccaggtgtcggccttcatcctgcagaagatgaaggaaaccgccgaaggctatctgggcgagaaggtcacccaggcggtgatcaccgtccccgcctatttcaacgacgcccagcgccaggccaccaaggacgccggccgcatcgccggcctggaagtgctgcgcatcatcaacgagccgaccgcggccgccctggcctatggcctggagaagaagggcgccggcaccatcgccgtctatgacctgggcggcggcaccttcgacgtgtcggtcctggaaatcggcgacggcgtgttcgaggtgaagtccaccaacggcgacaccttcctgggcggcgaggatttcgacgcccgcatcatggattacctggccgacgagttcaaaaaggagcagggcatcgacctgcgcaaggaccgtctggccctgcagcgcctgaaggaagcggcggaaaaggccaagatcgagctgtcgtcctccatgcagaccgaggtgaacctgccgttcatcaccgcggacgcctccggccccaagcacctcaacatcaagctgacccgctccaagctggaagccctggtcgaggatctggtcgcccgcaccgtcgagccctgcaaggcggccctgaaggacgccggcgtcaaggccagcgagatcgacgaggtcatcctggtgggcggcatgacccgcatgcccaagatccaggaagtggtgaaggaattcttcggccgcgagccccacaagggcgtcaaccccgatgaggtggtggccatcggcgccgccatccagggcggcgtgctgaagggcgaggtcaaggacgtcctgctgctcgacgtgactccgctgagcctgggcatcgagaccctgggcggcgtgttcacccgcctgatcgaccgcaacaccaccatcccgacgcgcaagagccaggtgttctccaccgccgaggacaaccagaccgccgtgaccatccgcgtcttccagggcgagcgcgagatggccgccgacaacaaggtgctgggccagttcgatctggtgggcatccccccggcgccgcgcggcgtgccccaggtggaggtgaccttcgacatcgacgccaacggcctggtcaatgtcagcgccaaggacaaggccaccggcaaggagcagcagatccgcatccaggcctcgggcggcctgtccgatgccgacatcgagaagatggtcaaggaagccgaagcccacgccgccgaggacaagaagcgcaaggagctgatcgaggctcgcaaccacgccgacggcttgatccacaccacggagaagagcctcaaggaattcggcgacaaggccggggccgagctgaccggcgccatcgagaaggaaatcaccgcgctgaaggcggtcatggacggcgatgacgtcgaagccatcaaggccaagaccgaatccctgatgcaggcctccatgaagctgggcgaagccatgtacaaggcccaggaagcggccggcggcgccgaggccgaggctgcggccggtggtcacggcggtgcctcgggcagccatgacgacaaggttgtcgacgccgacttcgaagaagtcgacggcgacaagaagggcaagtaacggatccgcaccagaccctctcccgcatgcgggagagggaggggcccaagccggaggcttgggagggtgagggccggaaccggcgggatggatcaatgacccctcccacccgcgccgcccgcgccgtctcccgcgaacgggcgagggttggggtaggaaagccatgagcaagcaggactattacgaacttctgggcgtcgagaagggcgcctcgcccgacgacatcaagaaggcctaccgcaagcaggccatgcagttccacccggaccgcaatccgggcaacgccgatgccgagcagaagttcaaggaaatcaacgaagcctacgacgtcctcaaggacgagcaaaagcgcgccgcctatgaccgcttcggccacgccgccttcgagcagggcggccccggcggcggtggcggcggtggtttcggcggcttcggcggcggcggcttctccgacatcttcgacgagatgttcggcgagttcatgggcggcggcggacgccgtggccagtccaccggacgtggcgccgacctgcgctacaacatggacatcagcctggaagacgccttcgctggcaagaccgccaccgtcaaggtgccgtcctcggccccctgcgaggattgcaagggcaccggcggcaaggacggcgcccagccggtcacctgctcggcctgccacggccacggcaaggtgcgccagcagcagggcttcttcaccatcgaacgcacctgccccacctgccagggcatgggcaagatcatcaaggacccctgccggtcctgcggcggctcgggccgcacccgcaaggaaaagaccctgcaggtcaacatcccggccggtgtcgaggatggaacccgtatccgcctggccggcgaaggcgaggccggcatgcgcggcgcgccggcgggcgacctctacatcttcctgtccatcgccgcccaccgcatcttccagcgcgacggcgccaacatcttctgccgcgtgcccattcccatgaccacggccgccctgggcggcaccatcgaggtccccaccatcgacggctccaaggccaaggtcaccatccccgaaggcacccagaccggaaaccagttccgcctgcggagcaagggcatgagcgtcctgcgcagcccggcccgcggcgacatgttcatccaggcggtggtggaaacccccgtcaacctgaccaagcgccaaaaggaactcctcaacgagttcaacgaggccggcgaaggtgagaaagccaagaactcccccgaaagccaaggcttcttcgccaaggtcaaggagctctgggaagacctcaaggaaggctgacggagccctccccgcccccattacccccctctccctcctgcgggagagggccggggtgagggccttcttgcgaagggactcgtcccttcgcgcatccctgtatccttaagctgcggaaccatccgcccgaatatcgacctcgaatcggcattcagctatggtcattaaactcaatggcatggctaggcggcgatatggataaaccgaaacgggcaaggccgaaagctgagaaactcccctccacggcaaacctccaatctccgccgagagggttatcggccgccgccgccgaattgataatcaaggcgttcgccccggcttcggagaatatcggaggtctccttggagacctgacggcgcattttaaggctcgcaatctggacaaattggccaggtattggcgcggcgagcttgaaaagcgcgaggtaagtcccgaagctcttgccgcgcttcccttcgcgacggctcatcgcgtattcgatgatgcatccaaagaagatgacgacgatgtcctgaagctttgggcttccttgctggtaggggcaatgacccgcggagcagacatccaagcgcacaaaatgctttgcggaatattaaaggatcttgagggtccggacgcggttcttcttgagatcatttggatgcgagcaaacaaaccgtccgacgatcgaacggagtattgcaaagagcgtctattcgccttcgaggctgagcgatggaattgtctaagtaattttatgaggcaagcagcagttcagaacataatgcgcctaggatgcgctgtatttagcagcagtataaatactaaatttaaattcaagagtcttggacgtaattcctttaatagagacccattgccaagtttaagtgaccaaattgaagacacgctatcagaaatcgaacaaaaaatttcttccgccatgcgctattcgtctggtgcggatgaaccttcaggcttccatgaatcttatgagaaaaaaacgtatctccgtgctgctgcggttctgaccctgacaccgttgggaagaaccctcatggaggcatgtcgcggaaatccatggagaagtgaaggtgcgtctgccgacctttaacgaccagggatgcgcgaagggacgagtcccttcgcaaacagaccctcttccgcttgcgggagagggagagcgacagagaggctgaaccggggccgccaccaccccatgggttgccccttacctcaagccgtgtcatcttcggccggttcgggagaagcacagtgcggcatcgccctcgtggggaaaacatcatccggttcgacagtgtcgggctgcgctacgggcttgggcccgaagtcttgcaggacgtcactttcaaattgccggccgggtcctttcatttcctgaccgggccatcgggcgcgggcaaatcctcgttgctgcgcctgatgtatctgggcttgcggccgacgcgcgggcgcgtggtgctgttcgaccgcgacatcgcggcgaccaagcgctacgagctgccggcgctgcgccgccgaatcggggtggtgttccaggatttccgcctgctcgaccacatgacggcactggacaacgtcgccttgccgctgcgagtgcgcggcgtcaaggaatccgagatccgcaggcatgtgccggagctgctgtcctgggtgggtctggccgaccatctgggggccaagccctcgaccctgtcgggcgggcagaagcagcgcgtggccatcgcccgggcggtgatcgggcggcccgacctgctgctggccgacgagcccaccggcaacgtggacgaccacatcgccatgcggctgatgtatctgttcgaggagctgaacaagctgggcaccaccatcgtggtggccacccacaacgagctgctggtgcggcgtttcgcccatctgccccgcctgcacatcgagcacggcatggtcaccaccttgcacaatgagccggtggtggacgatctggaggcggagtgatgctgttccgccgccgccattccgatctgcccctggccggcgacgccacctcgcgctttttgccctggctggtggcgctgatggtgttcctgtcgtccatggcggtggcgggagccttcgtcatcggcgcggtgatggaccgctgggaccgcgacgtgtcgggcacgctgaccgtgcaggtcctgccggcgggaggcgaccacgccgacgcggtgaccgacgaacgggtgcattcggccatcgacgtcatgcgcaaggtgcccggcgttctctcggtcaaagcctttgacaagaagcgcaccctggcgctgctggagccctggctgggcagcaccgagatggtgcaggacatgcccctgccccgcctcatcgacgtcaccatcgacccggacgcccgcatcgacctgaccgaggtggcgttgcgcctgtcgcgcgccgtgcccggcgcctcgctggacgatcaccgagtgtggctgtcgcgcctcatcaacctgtcgcgcaccatgcagtggctggcggtgctggtggtggtgctgatcggcatggtgacctcggccacggtggtctacgccacccgcaccggcatggcggtgcatcacggcatcatcgaggtgctgcatctgatcggcgcccatgacgattacatcgcccggcaattcgccgaccgcgccttcgcgctgggcatcggcggcgggctgatggggctggggctggccgtgccggccctgaccgccatcggctgggcagcgaagcggctggagggcggctttctgcccagtctcagcctgccggtgctgggctatgtggccatcgggctgctgccgctgatggcggcgctgctggccatgctgacggcgcggctgaccgtccacggcaccctggccaagatgccatgagccgggacgcgtttcgccgcctcgccgtcggaatcatggtggcggtgggcaccctgctcggcgcctggggcggcgggctgctgtggttcgccgccgatctggccatccgggtggaagaccagtccacggtcaccgacgcggtggtggtgctgaccggcggggccgagcggctgaattcgggcatcgcgctgctggaagccgggcgcggccgcaagctgttcgtctcgggcgtgcaccggggcgtcgacctgcccgacctgctgcgccaggcccatgtctcgcccgagcgggcccgatgctgcatcgtgctgggccacgccgccgacgacacggtgggcaatgccaccgagaccgccgcctggatggggcgcgaggggttctcgtcgctgcgtctggtgacggcggcctatcacatgcgccgctcgctgctggagctgcggcgtgccctgcccgacgccaccatcatcgcccacccggtgtttcccgatgccttcaagcgggaccagtggtggcgctggcccggcaccgcccatctgctcgcggtggaatacaccaagtatctggcggcgctggcccgaccgctgatcactcccaagaaaaccgagaggaagccgtgaccgttctgcgctccgccctgttcatcgtcttcacctgggtctggaccctggtgctgtccattgtgtacctgccgctgctggccctgccgcgcaaggccatggggccggcggtgcgcctgtggctttggggcatgctgggggcgctgcgaatcgtggcgggtctgtcgtgggagctgcgcggacgcgaaaatctgcccgccggcccgttcgtcgtggcctccaagcaccaatcggccttcgagactttcgtcttccacctgctgctgggcgaccccgcctatatcctgaagcgcgagctgttgtggatacctttcttcggctggtacctggccaagtccggggtgatcgccatcgaccgctcggcgggcaccaaggcactgaaagccatggtcaagggcgccgaggaagcggtggccgagggccgtccggtggtgatcttccccgaaggcacccgcgccgcccccggcgccaagctgccctaccattcgggcgtggccatgctgtacggcgcgctgaaggtgccggtcgtgcccattgccttgaattccgggctgttctggcgccgccggggctttgccaagaagccggggaccctgaccctggaggcgctggagcccatcgcgccgggtatggaccgcaaggccttcatggccgagctggagactcgtatcgaagccgcaacggatcgcctgatcgccgaagcgcgggagcgccagcccggcctgtgaggacttatgcccggcgggtgggccaagcccgcccgctgtggataagtctgtggatgcacacggggacggaatccttccccagaccccttggctgtgcaagacggggataagtggaatcagccctataagctcaacgccttgtccttgcccgaccctgtggagcacaaaaaaagaacatctccttgattcacggtcgccccgagtcctaaaatcagtctgcaaagccctgtcataccaaatcccgatgagctgagctcaaggggatttggttaggcccaaggggccgcgccgcttatgcggcgggaggcaagggcgcggaggcgcccgcccgccgattgagggcgatcccgatgatcggttgcgatcatcgggatcaggtagaagagggccggaggagagagacgggtccatgactcaggtggcatccatttcccagcagatctgggacatgaagtatcggctgaaatccgccgagggcacggccctagacggcaccatccaggacacctggcgacgggtcgcccgcagtctggcagcggccgaggccgaccccgccctgtgggaggaacgcttcttcgaggccatggaggacttcaagctcctgccggccggacggatcatctcgggggccgggaccgatcgccgggtgacgctgttcaactgcttcgtcatgggcgacatccccgacgacatggccggcatcttcgagcatctgaaggaagccgccctgaccatgcagcagggcggcggcatcggctacgacttctcgacgctgcggcccaagggcgccccggtcaagggcgtgggtgccgacgcctcggggccgctgtccttcatggatgtgtgggacgccatgtgccgcaccatcatgagcgccgggtcgcgccgtggggccatgatggccaccatgcgctgcgaccatcccgacatcgaggccttcatcgacgccaagcgcgaggcgggccgcctgcgcatgttcaacctgtcggtgctggtcaccgatcccttcatgcaggcggtcaaggaagacggcccgtgggagctgaccttcaagggcgtgacgtataaaagcctgccggcgcgcgagctgtggaacaagatcatgcgcgccacctattcctatgccgagccgggcgtgatcttcatcgaccgcatcaaccggctgaacaacctgtcctattgcgaagagatccacgccaccaacccctgcggcgagcagcccctgcccgcctatggcgtctgcctgctgggctcgctcaatctggcgcgcctggtggacaggccgttcgaggacggcgccaggctcgacctggatcagctggaccgcttggtccgcgtcgcggtgcgcatgatggacaacgtcatcgacgtgtccaactatcccctggaacgccaccgccacgaggcccaggccaagcgccgcatcgggctgggcatcaccggcctggccgacgccctgatcctgtgcggagcccgttatggcggcgcccaggccatccgcctgaccgaaacctggatggcggccatccgccgctcggcctatctcgcctccaccgaactggccaaggaaaagggagccttccccctttacgatgccgagaagtatctggcgggcgagaccatccagtccctggattccgacgtgatcgaggcgatccgggccaacggcatccgcaacgctctgcttacctccatcgcgcccaccggcaccatctcgctgttcgccgacaacgtgtcgtcgggcctggaaccggtcttcgccttcacctatacccgcggcgtgctgcaaaaggacggcacccggcgcgaggaggaggtcagcgactacgcctatcgcctgttccgccgccagcggggcgagaatgcgccgctgccgtcctatttcgtcgacgccctgtccctgacgccgggtgaccatgtggtgatgcaggccgccgtccagaaatacgtggactcctccatctccaagaccatcaacgtgcccgaggacatctccttcgagtcgttcaaggacgtctaccagcaggcctacgacctgggctgcaagggctgcaccacctaccgccccaacgacgtcaccggcgccgtgctggaggtcaagaaggaggccaggcccgagaatgccgacgagccggaactccccctggaaaaggcccaggtcaagcattccgaccccttcgaggcgggcggcatcgtccacctgacccagccgctggaccggcccgaggccctgcccggctccacctacaaggtgcgctggcccgattccgaccacgccatgtacatcacgctgaacgacatcatccaggacggtcgccgccggccgttcgaggtgttcatcaactcgaagaacatggagcacttcgcctggaccgtggcgctgacccgcatgatctctgcggtgttccgccgcggcggcgacgtggccttcgtggtcgaggagctgaaggcggtgttcgacccccggggcgggcaatgggtgggtgggcgctatgtcccctcgctgctggccgccatcggcgaggtcatcgagcgccacatgatcgccatcggcttcctgcccgatcccaaggcggcgcgcgagcccatcgaagcccgtgatcaacgctatggggacgaccgctatggcgaggagcgcaaggtggtcaacggcgagacccgcctgcgccactgccccaaatgcaaccagcccgccctgctgcgctcggagggctgcgatacctgcacctcgtgcggctattccaagtgcgggtgaggaagggtacccgtgcggggctcccgccccggtccccggttggaggctatgcctccaaacctcccttttgattaagcgggagagtctggatggaaacctccatccgtctcgacaagtggctgttcttctgccgttttttcaagtcgcgctcgctggctgcaaatgtggttgagagcggcggcgtccgcctgaatggccttcccgtcgccaagcccgcccatgcggtcaaacccggcgaccgggtgagctttcccgccggtccctatctccgcacggtcgaggttgtcgccctgggcacaaggcgcggccccgccctcgaggcccaggggctttaccgcgatctgggcaaggagcgggcgcccgaggaatagcgcgctcggaggaaccctccgaacctcccttcttttgaaaatcaaagggtgggaccgggaggcatgcctcccggcggggcgcggggcggagccccggtctctccctacccgaacagcgccctggacgccgccgccgggccggcacccggcttgaccttttcgcccagcacgctttccagcgccgtcagacaggccatgacgtgccggggcgtggcgctttggcccatcaggccgatgcgccagaccttgccggccagggcgccgaggccggcgccgatttccaggccgaagcgggccagcaattgggcgcgcacggccgcctcgtcgacgccctcgggcacggtgacggcgttgagctggggcagacgggactgttccgccaccagcaggccgaggcccatggcctccagcccggccttcaaggcctcgtgcatggcgcggtgccgggaccaggcggcgtccaggccttcctcgtgcagcatgaccagggattcatgcaggccgtagagggcgttaaccggagcggtgtggtgataggtgcgcttggcgccgccaccccaataggcggtcagcagggtcaggtcgagaaaccagctctgcaccttggtcttgcgggatttcagcgcctggacggcgcgggacgagaaggtgaccggcgacaggccgggcggggccgacaggcatttctggctgccggaatagaccgcatcggcgccccactggtccaccagcaccggaataccgcctagcgaagtgacggtgtcgacgatggccagcgccccatgggcatgggccagggcacagagcgcgcccgcgtcggattcgacgccggtggaagtctcggcatggacgaaggccagggccttgacgttcgcgttggctttcagcgccgcctccaccttggcggggtcgacgggcgtgccccaggcatcctcgaccaccacggcgcgggcgccgcaacgctcgacgttctccttcatgcggccgccgaacactccgttgacacagaccaccacggtgtcgccgggctcgatcaggttgacgaagcaggcttccatgccggccgagccggggccggacacggcgaaggtcatctcgttatcgctgcgaaaggccgcctgcaacaggcccttcagctcgtccatcatgccgacgaaggccggatccaggtgcccgatggtggggcgcgcctgggcggccagcacccggggatggacgtccgagggaccgggtcccatcaggatgcgcagcggcggctggaacgacgtggcgggcaggttgctcatgatggcggggctccggaaccggggggagtgatgggcaggggcggcagcttcatcagcttgacctgcccggcataaagattgccgtcctgcagggtgacggccagggtcagggtggggcggccctgggggtcgggacgcgccaggatggccagcagcatctcggcggccgaggccatgcccggctccaccatcttggcctcgaccaggcgggccagcatctctttccagccccgcacgcgggccgtggtggcgatgaggggctggagcgcggggtcgaaggcgaaggtgccgtcggcctccagggtcaggggcggccattccaccaccagccggtccagctccatgttaccgccggcattgctccaggcggccagggcggacagcggcggctcgtccggaatggtgcccatgatgcggccgtccacctgcaccagatccaggcggcggctgaagggcaggtgggggggcaggctcatctcgacgccgcgcgcctccaggccgaaatgggccgagggcttttcgtggccgggatcggggggattgagccattcataggtgatggccagacgctcggccgacagcggcccggcccccggctgttccagaatggcgcggcccgcctcgaacgcgaaggcatgcaggtcgccgtcgccatccacccgcagccgaagggtggtgcccgcgctggtgacgatcccgcgccagccgtcgcccagggccagttggtggctggtgcccagttcgagaagcggccccatggggtcgaggccgggaacacgcaaccgcacgccatcgctggcccaggaaatccccgccggcgtggcaaggctgagcgcccccagatccagcccgatctcggcgggaaagccgaacagggcgatgtcccggtgctccagacgccagccctcggcacggcgcgaggcgacgaagtcctcgacccccttgcgcaattgccccgccacgtggaaccaataggcggtgtaggcgccgcacccggccaaaaccaggacggccagactgagaccagcgagacggaaacgaacgggcatgggtatcgccactcctgaaccggataccacctctaacccgacgacgggctggaggcaaggcaccgacctctgggtcttcgcctacggctcactgatgtggaacccggagttccggcacgaagaagcgcgaaccgcccgcctgagcggctaccatcgcgccctgtgcatcctgtcccaccaatggcgcggcacgcccgaacggccgggtctggtcatgggcctggaccggggcggatcgtgccggggccgcgcctttcgggtggcggcacccgaggtgcccgaggtgatggcccagatctaccgccgggagatgcccaccggggtctatgccccccgcttcgtcccggtcaccctggacgatggacgccgggtcgaggcctgggccttcatcgcccggcgggaccacccgcaatacctggcccacgccaccccggagcaacgggccgccctggtacgccagggccacggccatgccggaccctgccgcgactatctggccaacaccatcgcccagctggaaatgctgggcctgggcggcaaggcgctgcggcagttgctggcgctggtggataagccataagcgccccgattccgccgcaatcggaacaaaactccgccgctttgggacgcgatgatccccgtcatcgcaacctcttcccgaagagatttccaaatgatccgcaaagccgttcttcccgtcgccggcatgggcacccgcgttctgcccgccaccaaggtgctgcccaaggaattgctgccggtggtggacaagccgctgatccagtacgcggtggaggaagccgccgaggcgggcatcaccgagatcgtcctggtcaccgcccggggcaaggagatgctggccgaccatttcgaccgcaacgccgagctggagcgttcgctggagacgcgcggcaagaccgagctgctggacatcgcccgcagcacctgccccaagggggtgagcatcaccaccgtgcgccagccggcgccgctgggtctgggccatgccgtgctgtgcgcccgcccggtgatcggtgacgagcccttcgccgtgctgttgcccgacgacctgatcctgggggcgcccggctgcctgaaacagctggtcgacgtgtggaacgagacccgcggccatgtgatcgccgtggagaacgtgcccgccgaccaggtggaccgctacggcatcctggacgtgatcgaggagaagggccgtctggcccgcgcccgtggcctggtggaaaagcccaagccgtccgaggcgccctcgaccctgtcagtgatcggccgctatgtgctggacgccagcgtgttcgacgccctggagcggcgtgagaggggtgccggcggcgagatccagctgaccgacgccatcgcccgcaccctgggcagcgtgccgctgcacggcgcccgcttccacggcacccgctacgactgcggcaataaggcgggctatgtggcggcgatcatcgacgccgccctggcccatccggaaactgccgccgccgtgctcgcccatctcgaggcgctgtccggacgccgtgccgcctaattcctaaaacgtgtaatgcagcggatcgtatcggccaaattggcgatataatccgctgcatacaacttgtttgaattgaaaatcatctggcgactcggcaaccttggtacatgtccactgccgcatgaggttcgcctatgcttcgccacaatatcgttattcccgttttcgctgcattcgctctgctcgcggccggcttttcggcccgggccgagcccttggcctgcaagggccagggcggcgtcaaggagctgccctacgaatcggtggttcccagcggctacaatcatgaccgcttcgccacccagccccgcagcctgatgttctcgtacggcgccttcacctcgtccttcgagacggcggaggatcaggccaagcccgactcccccttcaagggcattcccaaatgggtgtcctacgagatgcacgccatgatgggcaccgacggcaagcccatccatccccagggcgccaagcgcccggtcaagtggtacgagctggaggccaccgacttcctgtggaccgagcccaagctgaagcccggcatcgacgcctcgtaccggggcttcgccgccctgtggaaccggggccacatggcggcgcgcaaccatgccaaccgcatttcgtggcaggagggctgcaacacccacaccttcatcaacgccctgccgcaattcgccgacatgaaccagggcgactggctggcgctggagaactatgccatcgccgccgccaacaagttcggcaaggtctggaccatcgccgggccggtgttcgagcccgaacgcgacgtcgacaccatcggcaaggacggcatcaccgtgccggtggccattccccatgccctgtacaagattctggtgatcgagaccaagggcaaggtggaggcccgcgccttcctgttccatcaggccgacgaggaccagcggggcggctatcgcaaatgcgccggcacgccccagtccaaatacgacctgaccacctattccacctcgctctcggcgctggaaaaggccacggggctgaaattcctgaccaccttgtccgacgccgaccgcagggccgtcgatgcggcctcggccaaggccccctggcccatcgaggccaagtattgggacgacaaatgcggcggaaaggacgatgacgatgatgtctagtccctgatccctactttacgccgccgccaaagacggcttggataggggcatggaatcgggcggcacggacatcatctggactcagttcatcctggcggcggcgctgacccgcgtcgcccgtcaggcggccgggcaggacggcgaggacgaggaggcgattcgtttctcctatgccgacacccatgccggcggcggacgattgcccactcccgccgccttgcccgccgtgctggcccggcgcggcgagttcatctcccgcgcctggctggatgccgtcgccgccggcggccaccatcccggctcgtgggttctggccgggcgggtgatcggcgccctgggcggcctggacttcgaggccgacgtcaacgacatcgatcccgccgtcatggaaggggccaagggccggcgcgaaggcggctgggtgcggttctggagccacgactggttctcgttcctgcgccaccgcttcgtgctggagccccggccccatttcgtgttcatcgacccgccgcccgacgatccccgcggtcccggctacgccatcgacgccgccatcctgctcgacaccctggacacgccctacatggtcgcctatcccgtggacgcctcgtcccaggatgccatcgaccagatcggccggtcggggctggaattgcggggaccaggtctggagcgcggcgtgctgctgggcggcggagccgagacggtggtgctcgacatcctgtccgatcttcgcctgctggcctggctgttggggggcgagctttcggtcaggctgccccgggcgccggccgacgattattgcatctgagggcatcatgaccatcaaccacgcggcaagtatcggcgatctggcgaagctggcgcggtggcgcattccgggcttcgccttcggttttctcgatggcggctcgggcgaggagggcggactgcgccgcaaccgcgagcgcctggaggccgccgtgctggcgcccaaggcctgcaccggcgccaagcccgataccacggccagcctgttcggccgggactatgccctgcccttcggcgccgctccggtgggcatgggcaacctgctatggccgggagccgatctgatggtggcgcgtcaggcggcgcggctgggctttcccgtggtggcctccaccgtcgccaccaccgccctggaagacattgccgccgccgccgagggccatgcctggttccagctttacgtttcccgcgaggagcgcatcaatcgcgacctcctcgcccgggcctgggcggcgggcatccgcgagctggtgatcaccgtcgatgtgccggtggccggcgaccgccgccgcgacgtgcgcaaccgcttcatcctcccgttcaagccggggccgcgcttcgtcgcccaggtggccatggcgccgctctgggccttgtccaccctacgggccggctcgccgggctttcccaatctgacccgctatgtgggcgaggtggacggcaagaccctggccggcttcatctcgtcgcagatcaaggacgacctcgcctgggacgacgtccgcgccttgcgcgacctgtggcagggccgcctgctgatcaagggaatcatgaccgccgccgacgccaggaccgccctggacctcggcgccgacggcatctgggtgtccaatcacggcggccgccagctggatgccgcccccgccgccatcgattccctggcggccatccgcgccgccctgggcaaggaggcggtgatcctcatggacggcagcatccgctcgggcgaggacgtggttcgcgccggagccacgggggccgatttcgtcttctgcggccgagccttctattacggcgcggcggcggcgggcgaagggggggccgcccgggccgccgacctgctggccgccgatgtgcggcggacgctgacccagatcggctgtccatcgtggatggggctggacgaaggatggctgtggaaggaatcgggctgccgcccgtaacccgcctggaggcgcagcctccagacctccaggatttttgaaatcaagagagggtttgggaggtttcctcccaatcagggctcggggcggaagccccgatcactccctcatcatccgctccgcccccagcaccgtatcggacagcaggggaaagcgggcggcggcatgcatttgatagtgccaccactcgttggcatagaagtcccagccggcggcgttcatcaggcccagcaggagcaagcggttgcgctgggcctcgacgctgaccccggtcaccgcgtggtgggagagcggcgtgaaggcgtcgaaggcggtgcccatgtccagggcctgaccgctggcggtgtccagcaggtcgaggtccaccgccacgccgcgggaatgggtggagccccggtgcggatcggcgaggaattcgggatcgggggtgtggttccacagcgcccattgcgcctcggccggacggaaggcgtcgaggatgcgcaggctcaggcccagcggccgggccaacgccaccgcctttcgcagcagcggcgccgcctcggcatgcagccagcagccggcggcgggggcgtagaccggctttcccgtgaaattgtcggccgtggcataggccagaagaatctcgacgccatgctcttcggcggtgatgggaaccagggggtgcatcttcctgctttcatttccaacgccggggaagtatagcggcgagatgatcgttctcgccatggacagttcgacctccgcctgctccgccgccctgtgggccgacggcacggtgctggcgcggcgcctgtcgcccatggcgcggggccagagcgaggcgctgctgcccatggtcgccgaggtgatggcagaggccgggctgtccttcgccgatctcggcctgctggcggtgacggtggggccgggagccttcaccggcctgcgcatcggtctggcggcggcgcggggtctggccctggccacgggattgcccctggtcggagtgaccaccaccgaggccgtggccgccggcgtgcccgagaccgagcggcagggccgcgccgtcctggtggccatcgagtcgcggcgcgacgagaagtggctgcagctgttcgattccgccctggttccgctgtccgaaatccgcgccctgtgtcccgagcaagcggcgcaactggccacggatgccgtggtggcgggcgacgccgccccggtgatcctgtcgttcctgcccggcgcggtggccgcgtcctcctcgggtttcgccgatgctgccctggtggccgccctggccgccggccgatggaaccggggggattccctgccgcccgagcccctttacctgcgcgatgccgacgtcaccctgccgggacggcccgcaacgggcggtccggagtgatcgaactggtccccgccgggctggtccatgccgaattgctggccggcatgcaccgtatctgcttcaccgaaccgtggagcgccacttccatggccgaggtcctggccctggccgggaccgaggggctaatcgccgtggagggcgggtcgctcgcccccgccctggagccgcccggcccggccgggctgatcctgtggcgccgcatctttgatgaagccgagattctgaccgtctgcgtcctgccgccctggcgccgccggggcgtgggggcccgcctgctggacggcgccatggacagggcgatcgggggcggcgccctgaccatgttcctggaagctgccgccgacaacgaggccgccctcgccctctacgcgtcgcggggattcgaacgcgtcggactacgtagggggtattacggagctatagacggagtcaccatgagttgccgactggacaagattccagtccagcattgagatgcggcaatatccacacgcggccagagggcttatttcttgcaaaccacaaggtggtgaatgcctgtcggaccttccccaggctccggggcgagtgacaggatttcgtggccgagttcggcaagagagcgcggcacatttcccagcggttccgcgcctttcaagcgtacatccacaatctctcccgagatcattcgctccaccagtaacttggttttgacgaaggtcatcggacagacttcgttggtaatgtcaaggctgtagttaggcttctcagtcatgcgaattgtgtcactttcatttgccgcaatggttattgccaggtttgtacgaaggatttatataagagcccactgaatgaaattggagggctgctctctatgtcggagcattcgaacagcggcgacctgctgggcctgaccacggaaatcgtggctgcgcatgtcgccaataatagcgtggcggttgccgatcttccccatctgattcaggaagtctaccgcaccctggcctcggtgggcagtgtccccgcggcacccgagcggcctcaacccgccgtaaacgtgaagaagtcggtgacccccgactacatcatctgcctcgaggacggcaaaaagctgaagatgctgaagcgccacctcaagaccgcctacaatatgagccccgaggaataccgggatcgttggggtctgccggccgattaccccatggtggcacccaattacgctcagcaccgctcgagcctggccaagaagatcggcctggggaccaagccccgcaagcgcaagcgggccgtctgaggcatcccattattccgggaagactcgtcttctcgacaagtgaaggagttccgggcatgatcccggaaccccggcttgacggggcgcccaaggcgccccgttcgtcgctggacccgtcggctaccggatcgcggcaatgatttcacgcatcgagcaacgctgcatcgacaagggtatgaagatgaccgaccaacgtcgggtcatcgcgcgcgtgctgtccgactcctccgaccaccccgatgtggaagaggtctatcgccgcgccaccgccatcgatccccacatctccatcgctaccgtctaccgcaccgtgcgcctgttcgaagaggccgatatcctcgagcgccacgatttcggcgatggccgcgcccgctatgaggaatcggcgggcgatcaccacgatcacctgatcgacatgcattcgggcaacgtcatcgagttcaccagcacggaaatcgaggccctgcagcgcgagatcgcgcggcggtatggctaccgtctggtgggacatcgccttgaactgtatggagttccgttgacttccggtgataaaccggaagagaaatagatcttgcggtcgaaccagcaccgcgaggacggaaccagagggatcatgcaatccgtgtctgagacacgcgaggtcgtcgacgggcttgaggtccggcttgcggaaagcgcggccgagattgccgctgcccaggcactgcgctaccgcgtcttctatcaagaaatgggggcaaggcccaccgaggccatgcgcgcccgtctggctgacttcgacgatttcgatgccgtttgcgaccatctgctggtcatcgaccgcgcccgggggacaggggcggccggagtggtcggcacctaccgcctgatgcgccggacggcgggcgagcgctttggccgcttttatacggcgggcgaatacgacatctccaatatcatcgccaatggcggccgcttcatggaactggggcgctcctgcgtcgatgccggctaccgcaacggcgccaccatgaagaagctgtgggacggcatcgccgcctatgtcttcgaaaacggggtcgagttgatgttcggctgcgccagcctgcccggcaccgacatccaggccctggccggtcacctgtcctacctttatcaccaccatctggcgccggaggacctgcggccgcgcgccctgccccagctgcatgtggacatggccctgctgcccaaggaggctctttcgccgcgccgggccttggccgagctgccgccgctgatcaagggttacctgcgcctgggcggcttcgtcggcgatggcgcggtaatcgaccatcagttcaacaccaccgatgtttgcgtcatggtcaaaaccgacctggttaccgccaagtaccgggcccattacgaccgcaccattcccggctggtccgaggaataggcatcaatgatttccacccccgtcgccgttttgcgcttcctcggcttcgtgctgtggaccctggcgctgctgccgcccttcctggtgctgcgcctggtgtcgcgcccccgcatacccgcctacacccgcttctactggaagggcgtgatgctcatcatcggctacgacgccgtggtgcggggccggccgctggaagacggctcgccggtgctctacgtggccaaccacgccagctatctcgacatcatcgtgctgggcagcctgctgcgcggctatttcgtcgccaagaacgaagtggcgggctgggccggtttcggcttcctggcccggatctcgcgcaccgtgttcatcgagcgcaagcccggcgccacggcgcgggagcgcaatggattgctcgaccgcttcgacctgggcgagtcgttgattctgttcgccgagggcacctccaacgacggcaaccatgtcgttccgttcaagagctcgttcttctcggtagcggaaggcgaggtgcggggcgccgaaggcataccgtgcacggtaacggtccagccggtctcggtggcctataccaagctggacggcctgcccatcacccgggcgctgcgcccgctcctcgcctggtatggcgacatgaccctggccggtcacatggtgggcgcgctgggtctgggccgcatcacggtggaggtggaattccatccgccggtcagcctggccgagttcggctcgcgcaaggtgctctcggcccattgccacaaggtgatcagccacggcctgacccgcatgctggcggggcggccggcggcgaatccttgactcccggtgccccgctccttaaccatgaattccccggacgcgtaaaacagtggcaaagagactcttcgtcaaaacctatggctgccagatgaatgtctatgactccgcccgcatggcggacgtcctggcgccgctgggctatggcccggccgatcacgccgaggaggccgatatggtcatcctcaacacctgccatatccgcgaaaaggcggccgagaaggtcttctcggagctgggccgcctgcgcaagctgcaggccgccaaggccgaggccggcgggcgcatgatcctggcggtggccggctgcgtcgcccaggccgagggcgaggagatcctgcgccgcgctcccttcgtcgacatcgtgctggggccgcagacctatcaccgcctgcccgagatggtggcccaggcggcccgggccggcggcgccgtgctcgacaccgagtttccggccgagcccaagttcgacttcctgcccgaaccccatgccgagggcaccagcgccttcctgtcggtgcaggagggctgcgacaagttctgcaccttctgcgtggtgccctatacccgcggcgccgagtattcccgcccggccgccgccgtgctggccgaggccgccaccctggcggccggcggtgtgcgcgagatcaccctgctgggccagaacgtcaacggctggcacgggggagagggctgggggctgggccgcctgatccgcgccctggccgaggtcgagggcgtcgagcgcatccgctacaccacctcgcacccccgcgacatggacgacgagctgatccgcgcccatgccgaactgccccagctgatgcccttcctgcatctgccggtgcaatcgggctcggaccgcatcctggccgctatgaatcgcggccatgatcgcgacacctatctgcggctggtggacaagctgaagtcggcctgccccgacctggccctgtcgtcggatttcatcgtcggcttccccggggaaagcgatgccgatttcgaggccagcatggacctgatccgccgggtcggcttcgtccagacctattccttcaagtacagcccccgtcccggcacccccgccgccgccatggagacccaggtacccgaggcggtgaaggacgagagactggcccaggtccaggccctgctgctggaccagaccatgcgcttcaaccatgcctgcgtcggacgcgaaatgcgcatcctgctcgaccggcccggccgccatgccggccagttactgggccgctcgccctatatgcagccggtccacgtcaaggccgccgcccatctgatcggcaccgttgtgccgctccgcatcaccaaggtgcatcccaacagcctggaggcggtccccgcgtgagcaacggcgacacctccctgatgcgcgaatttcccgacaacgccctggcccaggtgctgttcggcccccacaacgccaacctcgagcgcatcgagggtcatctgggcgtggggctggacgtgcgcggcaatacggtggccatctcgggcacgccggactccgccgccgaggccgcccgcatcctggacagcctctatgccctggccaagcgccagggccacctggagacccccgacgtggattcggcggtgcgcatggccaagcttcccgatggccacgaggacgccgccggcgatctggtcatccggacccggaagcgtcatatcgcggcccgcacgccgacccaggcggagtatatccgcgccctgggcgaggcgccgctgaccttcggcctgggccctgccggcaccggcaagacctatctggcggtggccaaggctgtctccatgatggtggcgggcgaggtggaccgcatcatcctgtcccgcccggcggtggaggcgggcgagcgtctggggtttctgcccggcgacctcaaggacaaggtcgacccttacttaaggccgctctacgacgccctttacgacatgctgcccggcgatcaggtggccaagaagctgctggccggcgagatcgaagtggcgccgctggccttcatgcgcggccgcaccctggccaattccttcatcatcctggacgaagcccagaacaccaccaccatgcagatgcgcatgttcctgacccgcatgggcgagcattcccgcatggtggtgaccggcgatgtcagccagaccgatctgcccgccggcgtgcgttcgggtctggccgacgccatccatatcctggacggcatccagggcgtgcgcttcgtgcgctttaccgatcgcgacgtggtgcgccacgatctggtgacccgcatcgtgcgggcctacgataaagccgaccgcgaggccaagggaaagaccagggaccaatgaccgtcaccatagagatcgccgtcgacatcccctgcccggcctggaccgaggccatgcccgatgccgaggcccgctgcggacgtctggccgccattgccctgggcgccgtcgacctgcccgacggcgtggtcgagctgtccatcgtgctggccgacgatgccacggtgcagggcctcaaccgcgactggcgcggcaaggaccagcccaccaacgtgctgtccttcgcctcgctggacgacgaggacgcgccggtggtgccgggcgcgccgctgctgctgggcgacgtgatcctggccttcgagacctgcgccgccgaggcccatgaccagggcaagactctggccgaccatttcagtcatcttgttgtccatggcgtcctgcatctgttgggctatgatcacatggacgacgaggaggccgccgagatggaagcgctggaaaccaccctgctggcggcgctgggcatcgacgatccctatggagagcaataaaggtccatgaacgatcctggcagtagcccgccccgcgacggcggggcaagcatcaagaaaacgggcgaaagcccgtcccgcgacagcggggcaacccataagaaatcgggcgaggaatcgctgttcggcaccatgcgtggttggctgaagggccgccgccgccccaagggcgccgaaaccgtgcgcgacgccctggaagagctgatcgaggaccgcgacagcgccgaaatccccatcgacgagcacgagcgccaacttctcggcaatatccttcacctccgggacgtcaccgcctacgacgtcatggtgccgcgcgccgatatcgtggcggtggaggccaagacctccctggaagcgctgatcgccctgttcatcggctgcggccattcgcgtctgccggtctatcgccgctccctggacgacgtcatcggcatggtccacatcaaggatctgctggaggtcatgggcgaaggcaagccgttcaacctgccgcggctggctcggcgcgtccagttcgtggcgcccagcatgcgggtcaccgacctgctgctggaaatgcggctgaagcgctcgcatctcgccctggtggtggacgagtacggcggcatcgacgggctggtcaccatcgaggatctggtggagcagatcgtcggcgagatcgaggacgagcacgaccaggacgaagagccggaactgaccctccgcgacgacggcatcgtcgaggccgacggccgcacccccatcgccgaattcgaggattgcatgggcgcggttctgaccgaggaggaacgggaagaggtggaaaccctgggcggtctggtctccttcgtcgccggccgggtgccgtcgcgcggtgagctgatcacccattccgccgggctggaattcgaggtcctggacgccgatccccgccgggtgaagcgggtgcgggtccgccgcgtcgccaccccggaaccggttgagacggaatgactctcgaagccctggccgcccgcttccaggccctcgccggctggcggcggcgcctgtccctgatggggctgggcatcgtggcggccagcgccctgccgcccacccacgtcctgccggtcctgctgatcgcctttcccgccatggcctggagcctggacgccgccaccacgcggcgcgccgcctttggcgccggcttctggtggtccaccggctggttcgccgtgggactgtactggatttccaacgccctgctggtcgacgccatccggttcggctggatgattccgttcgcggtgttcggcctgtcatccctgctggccgccttcaatgggctggccaccctggccgtgcatctgatgcgcctgggccggatcgcccgcattcccgccctggcggcggcgctgaccctgtccgagtggcagcgctcgtgggtgatgaccggcctgccctggaatccggtgggctcggtgtgggatgtcagcctgcccgtgctgcaattcggcgcgctgggtggcatctggggcttgtccctcctgacctatctggtggtgctggcccccgccttgctgagcgcgcccggcaaccgtcgcaccgtcgccgccctcacccttggcctgcccgccgcgctgtggatcggcggtaccctgcgcctggcgcagaatccagaggccaccgtccccgagatcaggctgcgtctggtccaggcggccgtgccccaggccaacaagtggcgcgacgaccagcgcgaggcccatctgcgcgaccacatcgccctgtcgcggggatcgggattcgaagcgatcagcgtgatgatctggcccgagaccgccgtatcctacttcctcgacctggaccggctccaccggcagatggtggccgccgccgtgccacccggcggattgctgctgaccggtgcgccacgcatcacgccccggggggtcgagcccttccagatctggaactccctgatggcggttaccggctccgccgagatcgccgccatctatgacaaggtgcatctggtgccctttggcgaatacgtgcccatgcgcgccatcctgcccatcgacaagatcacccacggcagcaccgatttctcggccgggccggggccggtcactctcgatctgcctggaattccgccgctggcgccgctgatctgctatgaggcgatctttcccggcgccttcatcgcccgcgaccagccccggcccggctggatcgtcaacgtcaccaatgacggctggttcggcctgtcgtccgggccgcatcagcatctggcggcggcgcgcatgcgctccatcgaggaaggtcttccccaggcccgcgccgccaacaccggcatttcggcggtgatcgacccggtgggccgactgaccgccctgctgcccactgggcgagcggggcgtccttgatgcttccctgccacaggccttgccggcccctctctacagccggttcggaaatatcatcccaggtttgatgcttctgctgaccagtgtggcggtattttttttgcggcggttgaattagcgattcaaggcacatacattgggcatatgtcaattgcgctaagcgtttcccgcgccgcgtgttgactgtatgcaatcgcgcacgtatggtgcccatacaactgccagtacagtgggcgccacacccacagacctattaggacgcagccatggtcaaaagcaatcgcaattccgcccctacccaccgcgggtcttcccggggtcgccttccttcgggcctgcccaatcccgtcgatatccatgtgggagcgcgggtgcgtctgcgccgcaccctgatgggaatgagccaggagaagctgggagagtccatcggcctcaccttccagcaggtccagaaatacgagcgcggcgccaatcgtatcggcgcatcacggctgttcgatctgtcccgggtgctggatgtgccggtgtcgttctttttcgatgacatggccgagacggtccaggatcagagcccggtggccgtggcacgcggcacgtccggtctgaacgaggaacccgccagtttcgaggccgaccccatgaccaagcgcgagacgctggaactggtccgcgcctattacagcatcaccgatccccaggttcgccgccgggtctacgatctggccaaggcgctggccgccatcggcgaaaccaagaaataaccctttgaaattctggctattggcccgggggcgattcgtcttgacgagtcgccccttggcctgtcagaagaaccccccggaggggtgtgcccgctcccgtggagattttgaccgcttgccgccacgctgatttcggctaagtgggtgcatcacgatggcgctccgttgcgtgttgatgcccctggtcctaattttggttggatctaggagggcttgcccgtgtccaaaaagaatttcctcttcaccagtgaatccgtgtccgaaggccatcccgacaaggtcgccgaccggatttccgatgccgtcgtcgatgcgttcctcggtgccgatccctatgcccgcgtggccgtggagaccctggtcaccaccaacctgatcgtcatggccggcgaagtgcgcggcccggcttcggtcaacgccgccctgatggacgagctggcccgccacgcggtcaaggacatcggttacgagcaggacggcttccactggaagaacgccgagatcatcaaccgtgtccactcgcagtccgccgacatcgcccagggcgtcgacgccgccggcgacaaggacgaaggcgcgggcgaccagggcatcatgttcggctatgcctgcaacgagaccccggtcctgatgccggcgcccatctactactcgcacgagatcctgaagagcctggccgaggcccgccattccggcgccgccccgcagctgctgcccgactcgaagagccaggtcaccctggaataccgtgacggcaagccggtccgcgccacctcggtggtggtctcgcaccagcatgtggacggcctgtcccaggccgacatcaaggaaatcgtccgcccgcacgtcaagaacgtgctgccggaaggctggatgcccgccgaggaccagttctacgtgaacccgaccggccgcttcgtcatcggcggtcccgacggcgataccggcctcaccggccgcaagatcatcgtcgacacctacggcggcgcggctccccacggcggcggcgccttctcgggcaaggatccgaccaaggtcgaccgctcggccgcctatgccgcccgctatctggccaagaacgtggtcgcctccggcctggccgacaagtgcgtgatccagctcagctacgccatcggcgtctccaagccgctgtcggtctatgtggacacctctggcacctgcaaggtggacgaggacaagctggccgtggtgctgcagcagctggtcgacctcagccctcggggcatccgcacccatctgggcctcaacaagcccatctatgcccgcaccgcggcttacggccatttcggccgcagcccggacgccgatggcggcttctcctgggagaagaccgacctggtggagcagctcaagaaggctttctaagctttcatgggcaagcatgccgaaaatggaaacgcggccgccgagcggccgcgttttttcggccggcgccagggcaaggccctgcgccgcaacgccctcggcttgatcgaggatctgctgccccgcctgacggtggcggtccccgagcccgacgagcgtgtcgagcccgccctgctgttccccggcgcggtgcgctcggtctggctggaggtggggttcggcggcggcgagcatctggcccaactggccgaggataatcccgacatcggcctgatcggctgcgaggtgttccggaacggcatcgccagcctgctcggccatgtccaggcccgccagctgggcaacaatgtccgtgtcttccccgaagacgtccgcctgctgctgccggccttgcccgacggctccctgggccgggtcttcgtgctgtttcccgatccctggcccaagacccgccacgccgaccggcgcttcatctcgcccgagaccctggacgtgctggcccgggtactggaaagcggcggcgaattgcgggtggccagcgacgatcccatctatgtagcctgggccgcccgtcacctggacgcccatccggccttcgagaagattctggccaccgccgaccgctctgcggtcccggccgactggcccgccacccgctacgaacagaaatgcatcaccggccgggcgccggtgttcttcctgtaccgccgccgggcgcgatagcagcccagcgcgataccacgtgtcatcttacggtcacatgtggtattgaggcggcgattaccgtaactgcccaggggcttccccatgtttttccgcatgttccgtgccttgatgcccaaggaagaggaattcgtcgggctgttcgccaagcacgcggagaagatccactcggccgccaaggcgctggaagccatgatgggcgacggcgccgacatcgatctgcatttcaagcagatctgcgcattcgagggcgaggccgacctcatcacccgcgaaacgctgcaggccctgcaccgctcgttcatcacccccttcgaccgcgaccagatccaccggctgatcaccaccatggatgacgcggtggacaccatcgaggaggtggcccagcgcgtcgacctctatggcgtcaaggaattcaccccggacatgcgggcgctggcgaccggcatcaccgagtgcgcccacctgctgaccaaggccattcccatgatgcgggaagtcacccgcaacgcggcggccatcaacgagctgtgcgacgccatcggccgccaggaaagcgccgccgacaagcgccagcacgaaggtctgcgcaccttgttcgccaccgagaaggacccggtcaagctgatcacccgcaaggagatctatcagcgcctggaaaaggtctccgaccgcttcgacgacgtggccaacgtcatcgagacggtggtcatcgaacaggtctaggcccatccgatggaatccgtcgccttccccatcatcgtcgccctggtcgtcacggccctggtgttcgatttcctgaacggcctgcacgacgccgccaattccatcgccacggtggtctcgactcgcgtgctgtcacccaaatacgcggtggcctgggcggcgttcttcaacaccatcgccctggtgttcttcaccaccagcgtggccaagaccatcggcaccggcatcgtcgaaccgggtctggtggacacccacctgatcttcggcgccctcatgggggccattgtctggaacgtcgtcacctggggactggggattccgtcgtccagctcccacgccctgatcggcggcatcgccggcgccggcatcgccaagggcggcttctccgccctggttcccgccggcttcctgaagaccggctcggccatcgtgctgtcgccactgattggcctggtgctggccatgaccctgatcctgatcgtgtcgtggctatgccgccgcaccgcgcccttcgtggtcgatcgccgtttccgcatcctgcaattcttctcggcggccatgtattccctgggccatggcggcaacgacgcccagaagaccatgggcatcatcgctgccctactgtacagccagggcatgctgggcggcgagttccacgtccccgtctgggtggcagtgctgtgccagctggccatgggtctcggcaccctgttcggcggctggcgcatcgtcaagaccatgggctccaagatcaccgacatgaagcaggtcgacggcttctgcgccaatgccgccggtgccgccaccctgttcggcgccacctggctgggcattccggtctccaccacccacaccatcaccggcgccatcatcggcgtcggctcggcgcgcaaggtgtccggcgtgcgctggggcattgccggcaacatcatcgtcgcctgggtggtcaccattccggcggcaggaacggtcgccgccctgttctactggctgtccacccacttctggtgatggcgctctgccccgcgcggggcgcccgccccggttcccgatttggaggtaaccctccaaacctccctttcttctattcacaagaaataaagggggtccggggcatcgccccggatgggttcgggcgatagcccgaaggagatgacggccccgaattactccggatcggcccccaccagggacgaatcgtccttcttggtccgctgctgcagggcgctccggccaagaatgcggaaatgggccagttcggcgatattggtggcatggtcgccgatgcgctcgagattcttggcgatgaacatcaggtgcgagcacggcgtgatgttgcgcgggtcctccatcatgtaggtgaggatttcgcggaacagcgaggcatagacgtcatcaagctcctggtcgcggtcgcgggccgccagggcgcggtcggcgtcatgggccagatgggcgtccatgacctccttgaccagccccagggccagccgccccaggcgcagcagcgagcgcatgggctctaccggcggcaggcggttgagcaccagcgaccgcttggcggcattggcggccagatcggcgatgcgctcgatctctcccgcgatcttcagcgccgccaccacggtgcgcaaatcgtcggccaccggcgcccgcagcgccaggacgcggacggtctgctcgttgacgaaggcttccagttcgtcgaccttgacgtcggcccccaccacccgggcggccaggtcgctgtcgcgccgctccagggcgtccagcgccgaggccagttgcgcctcggccaatccccccatgcgggcgagggaatcatccagccgggccagttccgaatcgtaggacttgacgatatgcggttcgccgatggtggtcattgtcgaatctcctcactcgttatctcgatgagcccctcaatcgccgggcggcggacctccgtccgccttggctcccgccgcatcagcggcgcggccccttgggcctagccaggtctcggcgagacctggtccctcagccgaagcggccggtgatatagccttgggtcagggaattggcgggcgcggtgaagatctgctccgtcgcgcccacctcgacgatctcgcccaggtggaagaaggcggtggtctgcgacacgcgggccgcctgctgcatggaatgggtgaccatgacgatggtgaagacgtcgcgcagctcgtcgatcagctcttcgatgcgcgccgtggcgatggggtccagcgccgagcacggctcgtccatcaggatcacctcggggctgacggcgatggcgcgggcgatgcacaggcgctgttgctggccgcccgacaggctggtgcccagattgcccagcacgtccttgacctctttccacagtcccgcccgctcgaggctggtccggaccaggacatccatctcgtcgccctcggccaccaggccatgcaggcgcgggccaaaagccacgttgtcgtagatggatttgggaaaggggttgggccgctggaacaccatgcccacccgggcgcgcagcagcaccgggtccatgccggcggggccatagatgtcctcgccgtccagggtggcctggccgctgaccttggcggcggggatggtgtcgttcatgcggttgagacagcgcaggaaggtcgacttcccacagcccgacgggccgatcagcgcattgacctcgcccgccacgatgtccagatcgacgcccttcaaggcgggcttgccgccgtaatggaccgccagggaccgggccgtcatcttgggctgggccggttgttccgtcatgtcatccttccatatccccgcagggcttataccgctggacgcggcgccagaaacgtgaaggatttgtttcagtcttgaagccggcggccccatggccatttatgccaagccgccccttcccgccggagagatcatgatcgacgaccaggaccagcgccaccgcgagaaaatggccaaaaagaaagcgtcacgcgacaagctgatggccaagaagaccggaggcacgcacggcgtggtgatcgtccataccggggcgggcaagggcaagtccaccgccgccttcggcatggcgatccgctgcgtcggccacggcatgaaggtgggcatcgtccagttcatcaagggtgcctgggacaccgccgaacggagggtgctggagggcttcggcgagctggtcaccttccgcgccatgggcgagggcttcacctgggagacccaggaccgtgcccgcgacgtggccgccgccgcccgcgcctgggaggtggccgccgccatgctggccgaccccgcctacaagatggtgatcctggacgagatcaacgtggcgctgcgctacgaatacctggacctggccacggtgctcgacgccgtcaggggacggccggagggccagcacgcggtgctgaccggacgcaacgccctgcctcccctgatcgaagccgccgacctggtcaccgagatgaccatggtgaagcatcccttcaaggacggcatcaaggcccaggcgggggtggagttttagagcggcgtaagccgcgaccagccgccattgaggcggcggccaagcggccggagggccgcgctaaggcagagggacaaatatcaagctaaatcattgcgcgtcaaatttgacgcgcaatgatttagtgcccatttgacgggcagttggccgcacatgcccaatccgcgtccgaaggggctggcgggcgccgctgtccggcccctataatcgccccttcgacttcctgcggtgacggcacaagaccatgagcaagatcaaaggccagcgcgccatcatccatcgcaaggcgatcatcgcccggctcgacgagctgtcggccgaggacctgcccaagaacaagcgccggatgaaggcgctggagatcttcaagcaggtgctggcctcgggccgtgccgaggtgcgcgcccggttcgacgcccatggcgacggcaccgccacggtgcgcgagaactgccttctgatcgaccagctggtccggctggtccacgactatgcttgcgaccgcgagttcccccagggcgtgcgcacggcgggcgagaccatgagtctggtggcggtgggcggctatggccggggcgagctgtcgccccattccgacatcgacctcttgttcctgctgccctacaagcgcatgccctatcacgagcaggtggtggagttcatcctctacatgctgtgggacatgggcctgaaggtggggcattccacccgctcggccgaggattgcgtgcgcaatgccaaggccgacctgaccgtccgcaccgccttgctggagatgcgctggctgtggggcgatcaggcgctgttcgaggatctcaggacccgctaccgcgccgagatcatcaccggcaccgccgaggccttcgtggaatccaagctggccgagcgcgattcccgccattccagcatgggcgattcccgctatgtgctggaacccaacgtcaaggagggcaagggcggcctgcgcgacctgcacaccctgtactggatcgccaaatacgtctaccgggtggaaaacgtggccgaactggcggagaagggcatcatctcgcgcccggcggcgcggcgcttcgccaaggcccaggccttcctgtgggcggtgcgctgccatctgcactacctgaccgaccggcccgaggaccggctgaccttcgacgttcagcccgagatcgccgtgcgcatgcattacgccgaccgcgcctgctcgcgcggggtcgagcgcttcatgaagcattacttcctcattgccaaggacgtgggcgacctgacccggctgttctgcgccgtcaccgaggaaaccttcaagaccaagccgcgtcggctgcagttgggccgcctattctcgcgccgcaccatcgtcggtggcttccagctggagggcggacgcctggacgtttgcgcccagaatcagttcgaaaccgatccggtcggcatgatccggttgtttcataccgccctggagcatggcgtcgacatccatccccacgctttggacctggtccaccgcaacctgaagcgcatcgacgccggcatgcgcaacgacccggcggccaaccggctgttcgtggagatgctgaccagccgcaagaatccggaagtggcgctgcgccacatgaacgaggccggcgtcctgggccgcttcattcccgatttcggccgcgtcgtcgcccagatgcaatacgacatgtaccacgtctacaccgtggacgagcatacggtgcaggcgctgggcatcctgcacgccatcgagcgcggcgacctcaaggacgaagcccccacctcgtccgaggtgatccatcaggtggtgtcgcgccgcgccctgttcgtggcggtattctgccacgacatcgccaagggccgtggcggcgaccattccaccctgggggccgaggtggtgatgaagctggggccgcgcttcggcctcaccgacgaggagacggaatccgccgcctggctggtgcgcgaacacctgtccatgagccgggtcgccttcaagcgcgacatcgacgattccaagaccatttccgacttcgtcgccctggtccagtcgcccgagcgcctgcgcctgctgctctgcctgaccgtggccgatatccgcgccgtgggtcccacggtatggaacgcctggaaggccggtctgctgcgcgagctgtattcgcgggcgctggaagtgatgaccggcggcctgtcgggcacggcgcgcgccgctcgcatcaaggccgcccaggatgccctgcgctccgagttgttcaagctgtcctggccgcccgaggacatcgaggcccatatcgcccgcggctattccacctactggaccaccttcgacacgcccatccacctgcgccacgcccgtctggtgcgcgaagccgaggcggtacgggccccgctcaccgtcgagccccgggtggacagccaccgcgccgtcaccgagatcatcgtctataccggcgaccatcccggcctgttctcgcagatcgccggcgccatggcggtgtcgggggccaatatcgtcgacgccaagatcatcaccctggccaacggcatggcgctggacaccttttgcatccaggattccgacggcggcgccttcgacagcccggccaagctggccaagctggccacctgcgtcgagcaggtgctgtcgggccgcacccgcctcgaccgcgagctggcggcgcgcaagggcaagctgccgtcccgcgcccatgtcttcaaggtgccgccccgcgtgctggtggacaacatgccgtcgcgctcccacaccgtggtcgaggtcaacggccgcgaccggccgggcctgctttacgacatcaccaatgccatgaccaatgtgggactgcagatctcgtcggcccacatctccacctatggcgagcgggtggtggacgtgttctacgtcaaggacgtgttcggccataagatcgaacacggccgcaagctggaccagatcaaggccgccctgctggccgccctggaagatcccgccgccaaggccgccgcgaagaccggggacggaaccaaggcggcggaatagcccccctcccaacctccccccacctgcggcggggggaggggcatgtttccggcttcagtccggttccatcatgccggtctcggcggcgaaggccaggtccctctcctcctccggagcatgctgggcgccgcgcaccaccagactcatggcgatggcggcaatcaccccgggaaccgcgaaggccatgaagttctgcatcagcggcaacttccaggccagcagcgtcccgcccaagaccgggccgagaatggcgccactgcgccccacgcccgaagcccagccgatgccggtggaccggatggccatgggatagaactgcgccacataggcatagagcaggatctgggtgccgatggtggtggcgccggccaccgccaccaggacatagagcaccagggtcgggctcttgacccccagcaggctgatggagattgcggcgatcacgaagaacgccaccaggacgcgcttcaggttcatgcggtcggcaatgtggccgccgcccaccgcgccgaagatagcgccgaaattcagcaccagcaggaagctgagactggaccccagcccgtagccggcattgttcatcagcttgggcaaccacgagcccaaggcatagaccatcagcaggcacatgaagaaggctatccagaacatcaccgtactgacgccgcggccaccggcgaacagcgccggcagcgacgcctggccggtggcgccggtgggaaacgagatctcgtcgccgggctgcggcttgtaggacggctccagccgggccagcttgtccgccgcctctgcggtacggcccgccttgatcagaaagccgatggattccggcagcaggaacaggatcaccggcagcagcagcaggggcaccgccgccacgaagaacaccgccgaccagccatagacgggaatcagcgtcatccccaacccggccgacagcatgccgcccaccgaatagccgctgaacatcaccgccaccagggtgctgcgcaaccgcttcggggcgtattccgtcatcagcgccacggcattgggcatgacgccgccgatgcctaagccggcgacgaagcggcagatggcgaattccgtggtgtcacggacaaagccgttcagcacggtgaacaggctgaacagcacgacgcaaacggcgatgaccggcttgcggccgaagcggtccgagagcgagccgaaggtgagcgccccgaacatcatgccgaacagagcataagagcccagcgtcccggcctgaatggggtccaggtgccattccttcatgagaaccggcagaaccacgccgtaaatgaccagatcatagccgtcgaaaataatgatcagcgcggtccagaacagaacgttccaatggaactttccgaacttcgcctcgtcgatcagcttgtgcgcattaaccaatgccatgggaaacatccctccacgcagagcgaatcaagacatgcgcaccgtcccggcggcaaaaacgccgacaggaggtgtcatatccaaccgattgctttgtctgattattttttgggtcaccgaccgcttcgggtcgggccttggcgccaccatagccgaaggaaccggccctgtgaagcgaggttagcgggttgcggagaaacaccacttcgggggcttttgcccccgatcccccaaccgggaagcacagcttcccgaacccatcatctttttaatccattgaaataaaaagaaactggtggctcggaggctgtgcctccgaacgggtctgggcggtagccctgccgcgaagcggagttttgttaaagcccggccaattcccgcaccgtggcccacaccgcatcggtgggaatctcggcgacgcagggaaaggcgtcctggttgctggcccgcttggggcaacgccacaggcagtggtagcactccatgggggcattgaggaaacgggcctggggcgggcgaatctcctcagggtagggcacgaagcagccgaaatgaccgccgccggccagcagcacggtgggcgctcccaccccgatggccagatggccggggccggaatcattgccgaccacgcaggcggcatgcttcatcacatccaccgtctggccgagcttgaggctgccgatggcgtcgatcaggccgggatgggcgatctccaccagggcgagcttggcataggcttcctgagggccgccaacgaacaccacccgcagcccggactccaaagcctgtttcgcaacagcaatgaaattctccaggggccagcgccgccccggctcgttggagccgatgaacatcaccacataaggcccgccctcgggcaggtcgggcttgcggtcgggccaggggatggacggcacttgcggcttcatgcgggttcccgacagcgcctgcaggaaggtgaagtgacgcaggccctcgtgggtggggtaggggccggtgtcgatcaccctggtggccttggccagataccaggaatattccgcccgggtgcgctcggtgatgaagggcgtgcagacgatgcgttcgggggcgcggctggcccagaccaaggtgtcggcggtcagggtcttgcgcatgaacatgtcgcacagcgccgtggcgaagccctggcgccggatccacagggcgatcttcaggcggtagagccacttcttctcgaaggcatgctcgtcgatggtcaccacggtgaagccgtcgaacacctcgttgatcaccgccttccaggaatggcagcccagcacggtgatctcggatttcgccaagcccagcacatccggataatgctccagcgcggcgcggaacatcaccatgtcgccgatgccgtccatgcgcaccaccacggcgcccttgcgccggcgcggagccggccacagggcgacaatggcgtcgatgggacggaacatccaccagcggcgacgcatgccacgcggaaacagggtcgatagcaggctcatggactagaagacgccccgggccaccgaatcacggacgaaggccagcacctgatcggtatcgatggcgttgacgcatttgtacatgccgtcttccagggggaacttgcagcggccgagacagccctggcattccatgggcacgtagacgaactgcacgttgccgggcaccacccggtcgtcatagggcacaccggcccccacataggcggcactggccatgcacagggtgggcacgcccagcagcaccgccagatgcaggccggcggtatcgacgccgatcaccagcttggaccccagcagggtggaggccagcttctcgaagcccgaagtctccatccggacattgggctgggtcagcagcgacatgtaatcgggattcttgtcgaagtcgttcttgtggcccgctaccagcacctgccagttgggcggcaccagatcggccagcagccgccaggtttcggccggcagcatgcgctgcttcacgcccgagaacggcaacagcacgatggtgggggcggacagggcctcggcattgggaagctggctgtcttccagcagggcgaggaccggcggctggcggtcgtccagcacctcgtcggcgaagcgcgaccagcggacgatcttgtcctgacgtaccggacccgaatcgaacagcaggtcgaagaccctctcgctctcctccaggcgctggtggaaattgcgcttgaagggcggcggcaccatgcccgccgtctcggccgggtcggcggtgatgatcagcgcctcgtcctggtcgtgctcgcggacgtaatccagcgagacgatcagccggtaatgctgggagaacagctccttgaagctgttccagcggtattccaattcgtccaggcggcgaaaatcgatgcggcgcagcttcagggtgcgggggaacagaaaggacatgccggcggcgtcggcacgacacagcagggtgacgctctcgtccagcttggccaggcgcatgaagcggggaagcaccgccgacaggaacaccatttcggctggcccgcgcgagctgaccagcaaaacgccttcggcccgcttcttgcgcttgcgatagcgcagcaggaaccgcagaaccggatcgagtagggcggcgatcttcatgaacctccctccaccatcctggcaatgtcggtcaaaatcgcgtccgagtcgagagccgcgacgcagggaaacatggaattcacaggcgggaggcggcaatcgcccaggcaaccggcgcaatccatgggctggtataacaccctgaggttgccgggcatcacctcgtcggcatagggcacgatctcaccgacaaagccggccgaggccaggcacaaggtgggaacccccagcgccgcggccaggtgcatgcaggcggtgtcgaccgagaccaccaggcgggcgccgcgcagaatgcctgccaattccgagaacggcgccggttcgaacgaaacgttgggcagatccagcagcggccggtaatccgggttcttgtcgagatcggagggatggccggcgatgcgcaggctccaccccggcggaaggatgtcggcgatgcggccgtaaagagcgggcgggctctgcttctggcggaccgccgaaaagggctggacgatcaccgtcgggccgggcagctccacctggggcggcatctgggcgggcgacagcgccacgcggggcggcggcagggtccggccggtcagttcgcaagcgaaacgggaccagcgcaccaccttgtccagcaaagcgtcgccggtctcgaccagccgtctccagcgcttggcgttggcgtcgaggcggctttgatacttggtccagggccgcgcccgcatggcggcgctttccggcgcctcgcaggcgaaggccagggcctcgtccagatcggggtggcgcttgaagtcggtggaagccaccagacggtaatgccggcggtagaggtcgtcgaaggtggcgccgcgataggccgcatccttggccagccggccgaaatccaccttgatcacctgaatgccggggggaaagagaaaggccatcttcgccccgtcggagcgcagcagcaccgtgaccgtttccccctctcgcgccagcgcggcgaaacggtccaccaccagggcgaacagcacggtgtcgcccaggccgcccgccgacagcagcagcacgccggaggcctcggcgggtcgttgcggccggggccgcaggcggcgcagggcgtcggagatcaggcgctgcagcttcaaggcgccgtcacctcaatagggagcgtaggacttttcctcgaccagcgccgagcccagcaggtcgttgaccttgcgcttggcggccgcccgctcgtcattggtgaagtagacggcacgggccagctcgacgaatttggcgccgaaatccttggcgcgttcgcaatcgcggatgtcgtcctcgatcacccacagcttcccgttgatggccttgagctcggccgacagagccgccagacccgcatgcttggggaattcgcgctcgcgcaccgccaccagctcatccagttccttggtgacgttggcgatcttggcggcgtcggtcagacgctcggccttgatctcgagaatggtgatcttgtcgatgatctcgccccacgacacgggcaccagaacggacatgacggacctatgcttgccggaaaccgagccggtcttagcagatttatgccgtcagcgcatctcgatcctgaccagcccgggcaggtcggcgaaatccaccaggatgcgccggacccggtcctgccaaagctcggcgaagcggacatggtcctcggcatcgcggctgccggctagcacgcgctgcagcctctcgcgcatttcgggatcggcgggcaccagttcgggatgatagtgggcaaccgccatggcgccgctgtcggagcggcgcaaagccagctcggcaccaaaccccgcgtcgaaccgcaggaggtcgttgcgcccgaaacggccggcgatacccttgaacccgcccggcccggcggcgccggtgaccagaccggccacggcggccatcacgccggtgactccgtcttcctggccatcgtccatcagcacctgggcggcgccgcgctcgggcatggaatcgggccacagggcgcgcagggccttgatggtcatcagccaggctccggccacggtggggcaggaatgcccggccagccgaaccgcatcctcgtagcgataggtgatcatgccgtcggacggcgcccccaggaaggcggccagggaatcctgcacggtgatggcgggggcatcggcgaaaaaggcgggaaaaggcatggcgacatcctgacgtgacgaaggccgcagcttgccctccctgccccatcctggtccttgagcctggtcatgcggaaaatatgtctcttctgtaaacacgttcacagattgctcaccatttatcccttagggtcgatgctaagacagtccgtccgctctcccgggattatcgagtgatatcatgattgcccttcgccagcttcttcccgccgtcgcattcctgctgctgggcgccgccccggcgggggccgaggagatcggcagcgtgtcgacggtgttcaaggcgctggggcccaacgacaagatcgtggtggaggccttcgacgaccccaaggttgccggcgtcacctgttatctgtcgcgggccaagaccggcgggatcaagggcggcatcgggctggcggaagacacctccgacgcctccatcgcctgtcgtcaggtggggccgatccgcatggaggggagtctcaaggacggcgacgtggtgttcaagaaggatacctcgctgctgttcaagaccatgcaggtggtgcgcttccacgaccgcaagcgtgatgtgctggtctatctggtctacagcgacaagatcatcgacggctcacccaagaattcggtgtcggcggtggccatagaaaagaattggaagccgtaatgaccgatatcctcccggccgaccagcgcctgcttctcgacgatgtgctgtcccgtctggccaaagtcgaggattcccccaccctgctgcgcttcatggcggaaatcctgaagaccctgctgcggcgccagggcgacgccaccttcctggccaccattcaggacgccttcgccgccggcctgcccggcctgggcttcgccgagcagaagggcctggccgccgaagtcatccaggtggtgatcaccaagcgccccgagatcgccctggcctggcagaagatccacggccaaccgcccggccggccgccggcgcccgtggccgcgccggcacccgcccccctgcgccgggccgccgacctgcccatggaaatgccgccgcccctgccgcccgaggccgacgactacgccttcacccaggccgaggccttcgtcgccgcccagctgggcgatgccctggacaagcgcctcgccctgatgcgggtgccgctgccggccattccctcggtggcctggtgcctggaccagcccttcttcctgttcgtgccgcaattcgccgccatcaccaaggccttcgtcaccggccccattctgcgccgctgccgcgacgggctggaaaagcgcgtgctgtcgcgtgtcgatcacgagatcctgaccaagcccgaccgtcaggcggcattctggggcgaggtgcgcgagctggtctggaaggtggtcgacgaatcgctgaccaagctggccacccatctcaaggcggccgaggccaagcaggccgccatcgcccgcaccggcaacgagggcaaggaaggcttcaagctggtcgacaaggcggtgaccaagccgcgcaactacaacatcctgggcgtcgagttcgccctgggcaaggtcaccaccacggaaaaggtcaagatcaaggtcccgccgccctacaagctggaacccaatgagatcgaggcccagaccctgatcgaggaattccgcaacggcgccgcccaggccggggtgaagctgcccgattccgccgacttccagtttcttcggacccttctcaacttcaatccccgcctgttcgcccaaagccgcgacgagctgatcggcctggccgcgcacgaggacaccaccagcggcttcctggccgaacgcctgaaggccgccgacaagaccttcaccaaccacctgaccgacgtgctggtgatgatgatgttcacccgctgcggcgacaccagcttccggctggcccagttccatgccgtctgcgtcgggtcggcgagggacaagagcgccatgctggccatgcggccgttcatccccggcgaactggcccggcgtccccacgaactggcgctgcaggtccgggaatccatgcgccgtcaccttcacctggatgccgtcctgggctcggtggagcgcctgctggattgctataaggtgatgggccgcaacctgttcggtaacgaactggaagaggcgagatcggtgatcgccgccttccccatgattttcgccgctgatcccgaggtgggtaccttttccaccatcgccaagctgatcctggccaccatcagcggcgaacagcccgaccggtccatctgcttgatgcgggtgggccaggcctacgatcggatcggccgcaagtcggcggcaacggcctgatttcagcgccatgcggcctcagaacaaattgggtaaaattgtcgatagtttgaaaactatactatgggcgcagggctcaccttcaggaaacccacgacttatactttagatgacggcatatcctgcggtggtgggaaatgaggaggccgtcatgctcgtcgtcgatctgggactcagccgccaatccaattatgcgcccctgaccgtcaatggtcccgattacctgatggagctgggccgtttcatcgcccggaccatcgccgacgtcgaggtccatacccatctggaccgcgccatggtcacggaaatggtcttccgcagcgaatgcgtggacgacgacagcgagatggccgagcattgctgaccaaaacaaaaccgccgctcccggtcaggagagcggcggtcatgtcggcaacgccttgggctacttcttcttcggcttggccgcggcggcgcgatcgatggattcctggatgatctgaccggcccgctccggcccgccccagcccttcagctgcacccacttgcccacttccaggtccttgtaatggacgaagaagtgctcgatctgctgcaccaggatcttgggcaggtcctcgtagctgttcacgccgtcatagaacggatgcagcttggaatggggcacggccaggatcttctcgtccatgccggcctcgtcttccatcagcagcacgccgatggggcgcgagcgcatcaccgagcccaccgccaccggaatacggccgaccaccatgacgtccacgggatcgccgtcggccgacagggtatgggggacaaaaccgtaattgacggggtagtacatggcggtgttgaggaagcggtccacgaacatggcgccggattccttgcagatttcgtacttcaccggatcgccgcgcagcggaatttcgatgacgacgttgacgtcgcggggcgggttcttgccgatggggatcttcttgaggtccatttttgctttgtttcccttatggagaagatagggctgtctcggccgccacatgggcgtaaccgaggtcccgggccacggcggcgtgggtgacgccgccatggtgaacgttgagacccgcgcggaaatgcggatcattcgacagtgcctgtaccagacccttgtcggccagggccagcacgaacggcaaggtggcgttattgagcgcgaaagccgaggtccgtgccaccgcacccggcatgttggtcacgcaataatgtaccacaccttggtccacataggtgggtgcggcgtgggtggtggggcgcgcggtggcgatacagcctccctggtcgatggccacgtccaccaccaccgagccgggacgcatggcgcccaccagatcgcggctgaccaggcgcggcgcgcttgcgcccggcaccagcacggcgccgatcagcagatcggcctccagcacatgatgctcgatgttgtccatggtggcgtaggcggtctccaccgtgttgagcagcagttcgtcgatctgggacaggcgcgacagggagcggtccagcaccaccacgcgggcgcccaggcccacggccatgcgcgtcgcgttggagccgaccacgccgccgcccaacaccactaccttggccggcgccacgccgggcacgccgcccagcagcacacccgagccgccctgttccttttccaggcaatgggcgcccacctgaatggacatgcgcccggccacctcggacatgggagccagcagcggcaggcggccattggaatcggtgaccgtctcgtaggcaatggccgtgacgccggattccaccagcgcccgagtctgctcgggatcgggtgccagatggagataggtgaagagaatctgcccctgacgcaacagggggaactccaccttctggggttccttgaccttgaccaccagctcggccgaagcgaacacctcggccgcgtcggcggcgatctcggccccggcggcgcgataggcggtgtcggagcagccgattccggcgcccgcacccgtctccaccagcacctgatgcccgtgatggacaagctcgcgcaccgagccaggcgtcagccccacccggtattcgtggcttttgatttccttgggaacgccgatgcgcattccaccctcaacacctggcctcaacacttggaaccgttcctaaaacctgacaatgaggctttggccgcgcagtttcaaccgggcttggacgcaacccggccctgctgccgcatcagccagggcagaatcagcagggcgggcagagtcaccaccgtggtcagcaggaagaaatccacccatcccagggcatcggccagccatccgctggtggaggcgaacaccgtgcgccccagggcggtcagcgacgacagcagggcgtattgggtggcggtataggccacgttgcacaggccggacagataggtcaccagggccgaggccgccatgccggccgtcaggttctcggcggccacgcacagggccagggcccaaaggtcgtgaccggccacggcctgccagacataggcgagattgccgagggattgcagcacgccgaacagcagcagcgcccgcatcacgccgagccgcgtcaccagggcgccacccaccagaatgccggccatggtggcgccgaagccgaagatcttgctgacataggcgatctcggccagggaaaagcccatcttgatgtacagcggattggccatggcgccggccatggcctcgcccatcttgtagccgacgatgaacagcagcaccgcccaccaggcgggccgcgtcatgaaatcggcgaaggggcaaaccaccgcgccgtaaagccacgccaccaccttggcccgagtcccacccagatgagggcgggcggcgaggtattcctcggcccggcgttcgcgttcggcggtggcggccgacaccttgacctggggctcgggtcccagcagcagcacgaccatgccgagccccagcagcgccgccatcagcccataggccgcgaaccagccgaaggtctgggcgcacagcatggcgccggcgcccgaggccagcatggccaggcgatagcccgcctgcaccgctccggcccccggtccctgctgttcgtcgtcgaggatttccacccgataggcgtcgagcacgatgtcctggctggccgacaggaacgccaccaccagggccagggcggcggtcagcccgatctcgcgcaccggatcggtggcgcccaggccgcagatggcggcgatcagcagggcctgaatcagcacgccccacgaccgccgccgccccaacagccgggtcagccccggcaggggcagccggtcgatcagtggcgaccacaggaatttcagcgcataaggcgtgcccaccagggcgaacaggccgatggccttgcggctgatcccctcggccgccagccaggccgacagggtggaaaaggtcagcgccaggggcaagccggacgcaaagcccagcagcagcaccatcatcacccgccggtcgagataggcggcaaagccagcacgccaggaggtgctcatgggcatatcattctgttggggctgggcattcaggaccacaagatattgagtctgccccactttaccccgtgatcacgccggcgacaaagccctgttctcttcccgccccggcccgaagggtgtaggttggcgcggttttctctcgcgcattcaccagggctttcatgaccgacaccgacaagaccaaggccgcgtcctccatgtggggcgggcggttcgccggcggccccgccgccatcatgcagcggatcaacgcctccatcgacttcgacaagcggctgtatgcccaggatatccggggctccaaggcccattgccgcatgctggtcaagcagcagatcctgaccgaggccgatggcgcgctgattctcgacggtctcgacaaggtgctggccgagatcgaggcgggcaacttccccttcagccacgccctggaagacatccacatgaatgtggaatcccggctggccgagctgatcggcgaggccgccgggcgcctgcacacggcgcggtcccgcaacgatcaggtggccaccgatttccgcctgtgggtacgcgacgcggtggacggcatggagagtgccctcaaggagctggtcaccgccctgctggaccgcgccgaggagcacgccgccacggtgatgcccggcttcacccatctgcagacggcccagccggtgaccttcggccatcacatgatggcctatgtggagatgatctcgcgggaccgctcgcgtctggccgatgcgcgccggcgtctcaacgaatgcccgctgggctcggccgccctggccggcacctcgtttcccatcgaccgcgaagccacggccagggacctgggtttcgccggtcccatgcgcaactcgctggacggggtgtcggaccgcgatttcgccctggaattcatgtcggccagcgccatctgcgccgtgcacctgtcgcgcctcgccgaagagctggtgatctggacctcgtcccagttccgtttcgtgaccttgtcggacgccttcaccaccggctcgtccatcatgccgcagaagcgcaatcccgacgccgccgagctgatccgcgccaagaccgggcgggtgatcggcgacctgaacgccctgctgatcgtcatgaagggcctgccgctggcctattccaaggatatgcaggacgacaaagagccggtgttcgaagtggccgacaccatggaactggccatcgccgccatgaccggcatggtccgcgacatgacggtgaacgtggacatcctgcgcgccgccgccggggcggggttcactaccgccaccgacatcgccgactggtgcgtgcgcgccctgaagatgccgttccgccgcgcccaccacgtggccggctccctggtcaagctggccgagggcaagaattgtggcctggaagacctgaccctggccgagatgcaggccatcgaaccgggcatcaccgaggaggcccgctcggttctctcggtggagtcttcggtgaacagccgcaccagcctgggcggcaccgcgccggtccgggtgcgcgaagccgtggccggcgcccgccggcgcctgatggacgaggccccatgatgatgcgcaccatcctgatcctggccctggtcctgggggtcgccgcctgcggccgcaagggcatgcccgaccggccggacgacgccgtctatccccgcgactatccttatacgccgctgcccagcgagtcgaaggccaggaaggatgcgggcactcccgatttgaacacaaaggccggttactgaccggattccaggaacggacatgaatcacttccactaccagaatggcgaactgttcgccgaggacgtcgccatcgcccgcatcgcccgcgaggtcggcaccccgttctactgctattccaccgccacgctgcagcggcactacacggtcttcgccgaggcgctgaaggcggccgggctggacgccaccatctgtttcgcggccaaggccaatcccaacatggcggtgatccgcaccttcgcccagttgggtgccggggccgacgtggtcagcgagggcgagctgcgccaggccctggcggccggcgtgccggcggcgcgcatcgtcttttccggcgtgggcaagacccggcacgagctggaattcgccgtggccaagggcatcttccagatcaacgtggaatccgagcccgaactggagatgctctccgagatcgcggcggcgcgcgggcaggtgatgcccatcgccatccgggtcaacccggacgtggatgccggcacccacgccaagatcaccaccggcaagaaagagaacaagttcggcatcgaatggacccgggcgcgcgaggtctatgcccgcgccaaggccctgcccggtgtcgagccggtggccatcgcctgccatatcggctcgcagctgaccgagctgaccccgttccgcgaggcgttcctgcgggtgcgcgatctggtggccatgctgcgcgccgacggcatcgacatccgccgcctggacctgggcggcggcctgggcgtgccctatgacgacgagaccccgcccgagcccgccgcctatgccgaggtgatcaaggccaccctgggcgacctcggctgccgcttcgtgttcgagcccggccgcctgctggtgggcaatgccggcatcctggtgtcgcgcatcatccgggtgaaggagggcagcacgcgcaccttcctgatcgtcgacgccgccatgaacgatctggcgcggccctcgctctatgacgcctaccactccatcttcccggtggccgagcccaaggcgggcgccgccctggccgaggtggacgtggtcggcccggtctgcgagaccggcgacaccttcgccaagcagcgccgcctgccgcccatgcggaccgacgaccttctggctttcggtaccgccggggcctatggcgccgccatgtcgtccacctacaacacaaggccgttgattcccgaggtgctggtcaagggcggtgattacgccgtgatccgcgtccggcccagttacgaggatatgcgctcgttggagagtctgcccggttggctgaatgatgagtgattgggctgccgcccaaacctgcctggaggtgaacctccagacctccctttcttttatcttcaaaaagggagagggctcgggaggccctgcctcccgatcggggtccggggcggaagccccgctgagggcctgaccatgcccaccctgtcccgcaagctgcgtctggctcgcctcgcgctgctgtgggagagggcatggccgcccctggcggcggctttgtccctgctggccctgttcctggcgctcgccctgttcgacgtggcgccgctattgcccttctggctgcatgcggccctgactcccgcctttgcactcgccatcgccgtcctggtggggaaggcctgccgtaccgagccgccctcggcggatgaggccgcccggcggctggaacgggactcgcacgtcgcccaccgaccgctggcggctctggccgacgatctggccaccggcgatccggtgctgtggcaggcccatcgggaccgcatggcgcgggacgcgcaacacctgcgccccggctggcccgatccggtcttgccggcccgggaccccctgggcctgcgcttcgccgccctgctgctgctgatcctggccatggccggggggcgttccgacatgggcggccggctggcccgcgccgtcgatccctattccctccgcccggccctcgaatccgacacattggaggtgtggatcgtgccgcccgcctataccggcctgggccagaccctgctgaagcccggccagggggccgtcaccgtcccggcgggaagcatggcccgcgccgtcacctcgtggcgcggctggagcggctccgccctctcggccggtggcagcgcggcggtgttcggcgagaacggccgcgccgaactggccttgaccgcggggcccagcctggatgtgcgcctgggcttgcggatggccgcctcctggcccatcacgcttcgcgccgaccagccgccctccatcgccgtcacccagccgcccaagggggacgagcgcggccgcctgaccctggagatggaagcgggcgacgattacggcctgacccgggcctgggtcgaggtccggcccctggaggagggagcggaaccgctccgcctcgatctcgtcctgccgggcgagcggttgcaccaggcccggctgatgctgcgcgccgatctggccgatcatgactgggccggaacaaaggtgcgcctgacacccaaggcggaagacggcgccggccagaagggcgaggcgccgccggtggagatcgtcctgcctgaacggatcttccgcaaccccctggcccgcgccctggtgcagtggcggcggcaattgagcgacgccccccgaatgggaccggagatcgccgaggaactgcgtcagatcatggagcagcccgaggccttcggtggcgacgaccgggtcttcctggccctgtcggtcagccgccacatgctgatgcgccccgaattcgagcgcgaccgcatgcgctcattgctgtggtacgccgccacccggctggaagatggcggactgccggcggccgagaagagcctggaggacgcccgctccagcctggaacgcgccctggccgacaaggccgatgccgccgagctgtcccggctggtggaccagctggaagcggcgctggagcaatggatggaggccctggccgagctgggcctcgatcaatccctgccgcccgagggctcggctcccgccgccgacctgtcggacatgctcgaccagttgcgcggcatggccgagaccggcgaccgcgagggcctgcgccgccgcctcgagcaattgtcgcggctgatggccgaaatgggcacgccccagaagggccagggcggcgatccggccgccgccgaggccatgcgccgcctgcgcgagctgacccagcgccagcaggacctgctggaccgcagtttccgcaaggcgccgcccgaggatcaggtcgcccccgacgaggacacccccaagccccggcgcaagccctcgccccgcgaagccgccgaggcacgcaaggaggcggcggagcaaaaggcgctacgccaggccctcgaacagctgggcaaatccatgccccagcccccggattcccttgccgaggcggaacgatccatgcggggtgcggaatccagcctgtccgaaggagagtgggccgaggccgccgaccagcagtccgaggcggtgaagcgcttgcaggagggcgcccgccagatgatcgagcgcatggaggccgcccggggcaagggagcccctgccctgctgccccgcgaccccttcggccgcacgctgaacggctccaccttcgccgatgacggccgcaccaaggtgccggggcgatccgacaccatgcgagcgcgggaaatcctgcaggaattgcggcgacgctccggccagccgcaccggccggaaccggagcgcgactacctcaagcgtctgctgaagccgttctgaccggggtgcctggcaggctgtgaaaaagctccccttcgggggcttttgcccccgatcccccaaccgggaagcacggcttcccggacccttcagctttttataaaaataggctggagttcttcgcacttaagctaaatcggaaagtcgaagaactcttaagcccgagcggcgcttgagccctgaaaaagcggagctttttcgtacagaccgaatcctagagtgcttcagcttaaagctgacgcactctagaggctcggaggctgtgcctccgaacgggttagggcgggtgccctgccgcgcaagcggggtttttccccagcctgcatgaactctatttggcttccgtgggcttggcttccgcggcgggagcagcgggcgcggccggaaccgcaggcggcatatccacggcaggggccggagccggggccggagtggcgggaaccggggcgggagccggcgacggcgtggccggaatcggcggcggcacggagcccgtcttggcgtcgccgctctcgacgaacaccaccaccacctcaacggcgttaggatcgggccgctccagcatgatcttgaagctggccgtgccccgcgacggcaattcgctcaccggcggctgcgacatcttttcctgaaccgcctgcttgttgcggtccatcagcaccagcttcatggtcggaatctggcgggtccgatcggtgatattggcgatgatgccacgcaccaccagcacatcggtgtcgttatggacgaagcgttccggcgtgccggccttgcgcagttcaagcccggcacccggcttttcccgccggagaccggcctggcccaacaattccccggcctcggggacggcttcgaccagctgatcctggaaataatagccggcaccacccagcccgccgagaatcagcaggaccagcaacgcccacagggcgcccgtccccttcttgccttcctgggcgggggtggagaacagctcgggtaccggctgcggttcgtcgtccaaaaggtcgacctcgccggggcgctccatgccctcgtcgggcggcatgcgattggcgaaggtgggaacaggcggcgcatcgagatcgaaatcgtcgtcgaccgacggcgacggcgacggccgggccgagggacgcggcgcatcgaacacggaatcgtcgcggaccgggttgaaccccgccaccttgctgaaatcgggcgcttcccgctccggcgtgctgaaggacggcccggccaggtccaggtcggtgtcgtcgtcatccagcgacagtggcgtctgaaaccacttatgcgcgcatttggcgcatttcagcttgcgcccattggtcccgagcgcactgtcgggaatggagaagttggttccacaggcgggacaggtgatcagcatggtctgcaagcaccggaaaagatttatttcttataggctggagccgggaccaacacaagcggctacgtgagtggctacaggcggatcaatccctcgggattactaagcaatccggcgaaggtggcggcgttgaccgggcgcgagaacaggaagccctgcatgatcgggcagccgcgcgccgccaggaaggcggcctgctcgcgggtttccaccccctcggcgatcacggaaaagcccagattgccggccagggcgatgaccgaggcgatgatggcgccgtccttggcgttgccgggcagttcggtgacgaaggcgcggtcgatcttcaaggtggagacggggaacagcttgagataggccagcgaggaatacccggtgccgaaatcgtccagcgacacccgcacccccagggtggtcagctggccgaggatctcgatggcgcggtccacgtcgctggccatcatggtctcggtgatttccagctccaggaccgagggcggcaggccggaaccggcaagagccgccttgaccttttccttcagccgcccgtcgtggaactgggcgggcgagagattgacgctgatggacggcaggatcagcccctgggcccgccattccgccacctggcgacaggcctcgaccagcacccagtcgtcgatggcaccgatcagcccggcccgctcggccaccgggatgaacaggccgggagagacatcggcccgcaccggatgacgccagcggatcagcgcctcggcgccgatgatggcacccgacagggcgtccaccttgggctggtagaccagacggaactggtcctcgcccaaggccagacgcaaatcattttccaggctgacccgctcggccacctggcggtccatctcgatatcgaaacagctatagggcaggccgccgcgcttggcgtgatacatggcggcatcggcccgcgacagcaggctttcggcgccgtcggcatcgtcgggataaagggcgatgccgatactggtgccggcgaacagctgcaggccctccatgtcgaagggttcggcgaaggcatagagcaccttgttggcgcaggcctgggccgccgtatggtcaccgacgctgggcaacagcatgacgaactcgtcgccgcccagccggccgatgacgtcgctggcccgcacgcaggccttgaggcggcgcgccacctgccgcagcaattcatcgcccaccgcgtggccgtagctgtcgttgatatccttgaagcggttgacgtcgaggtaaagcaccgccaggcgctcgccggtctgctcggcccgtacgatggcctcgcccagggcttccatcaccgtatggcggttgggcaggcgggtcagggcgtcgtggctggcatggaaccggatgcgctgttcatcgcgccgcttgcgggtgatgtcgcgcaacagcagcacgaagcgcccgtcctctcccttggcgtcggcgccctggtccacggcggtaagcgccaaggcggcgggaaagggctccgattccttgcgccgcgtccaggtctcgcccgaccactggccggtattggccgccagacgccacatttcctcgatctcgcgcaggccgatcatctcgaccgccagcagatcgcaggtctgcccgaccatctcggccgcattccagccggtcatgcgctcgaaggcggcgttgaccgccaggatgcgccgctcgcggtcggtgaccacaatggcctcgcccaccgtctcgaacaccgtggcggccagacgcagcgattcctcggcctgtttgcgcgccgtgatgttctggaccgtgccctcgtagcagaccagacggtcgcgtccgtcatagacggcccgggcattttcggcgatccagatgatctcgccgctgcgcgtccgcacccgtgcctcgaaattgcgcaccacggaatcgcgggccaggatttcgcggaaccgctcgcgatcggcggggtcgacatacagccccctggcgatgtcggtcagcccggcgatcagctcggccgggtccttatagccgtaaatccgcgccagggccggattggcgtccagatagcgcccatcgggagtggtgcggtaaatgccctcgaccgcgttctcgaacagcgaacgatagccgccgagatcatcgtcgttgcgggcaagcaccaacacatctccactcatggcgtcggaatccagatagatcaattctaattgggacagtgccactgacggtttatgcactgcaacagaatccggtaaggaccctacttttgtctctcggcgctggatttcccggccatgggactttaagaagatgggtcggcttttgaaaaggatcggggcatgaggatcggaatcgtcggctgcaatggacgcatgggccggatgctgatggaagcggtgctgtccgccgagggttgcaccctgtccggcggcactgaacgggcaggaagcgaggtcatcggcctggatcccggtacccttctgggccgtccgccggtgggggcgctggtcaccgccgacgcacgcaccctgttccaggcctcggacgccgtcatcgacttcaccgccccggccgccaccctggcccatgccgctatcgccgccgaactgggcaaggtgctggtggtgggcaccaccggcctgtccaaggacgacgaggcccggctggccgaagccgcccgctccacccctgtggtctatgcccccaatttcagcgtcggcgtcaatctgctgatggcgctgaccgaacgcgccgccgccatcctgggcgatgattacgatatcgaaatcgtcgagatgcatcatcgccacaaggtggacgcccccagcggcacggcgctgggcctgggccgttcggccgccctgggacggcaggtggccctcgacagccggtggtgcaaggcccgcgacggccataccggcgcccggcccaagggcgagatcggcttcgccaccctgcgcggcggcgacgtggtgggcgatcacacggtgatgttcgccgccgagggcgagcgggtggaactgacccacaaggcgtcgtcccgtaccgtcttcgccaagggcgccgtgcgcgccgcccgctgggccaccggccagaagccggggctttattccatgcgcgacgtcctggggctgtgaccgatgagcgatgagcaagcgccagcaccgcccccgaccggccgccgctacaaggaatgggagcactcttacgccgaggaagtggcgttttcgcgcaagatcttcttcggcatgatgatcgccctggccattctgctgggggcgctgacctacggggcgctgaggtagaatctcgccggggagatctattgggctatcgcccaaacccatccggggcggaccccggacctcctttattttcatcaataaaacaaagggaggtctggaggttcacctccaaccagggtccggggcgggagccccgcaatcagaccttggtgtcgacgttgttgccgccgcttttggggccgcccttggccacgcccaccaaagcggggcgcagcaggcggtcgtgcagggtgtagcccgcctgcatcaccagcaccacggtgccttcgatctggctggggtcttccatctccatcatggcctgatgcaggttgggatcgaaacgttcgccctgggccgccaccagcttgatgccgtagcgttcgaaggtggccagcaattcccgctcggtcatctcgacgccggtggtgagcgcggtcagggattcattgccttcgcgcgcgctggcgggcaccgagtccagggcgcggcgcagattgtcggccacgctcagcacatccttggcgatgttggaaatggcgtacctgccccgatcctcggcctgctgctccaggcggcgacgggtgttctcggtctcggccttggcgtagagcacgtcgttcttgagcttggcgatctcggcctccagctccttgatgcgctcggagtccacggccggcggcgcggcggattcggcggccgggccctggtcggcgctctggtcggcgctttcggcggcgggcatctgctcggcggtctgatcctgggtcatggcaaggctctctcgatgtcttggggttaggtgggttgcccgatcaggcggccgatcaccttggcggtgtaatcgaccatgggaatgatccgggcgtaattgatgcgttgcgggccgatcacgccgatggcgccgacgatgcgctcgcgcgcgtcgcggtagggcgccaccaccatggaacagccggtgacgccgaacagatcgctttcggcgccgatgaagatctgcaccccgtcggccacctgagtgaggtccaccagccgcaggaactgctcggaggtttccagcgcctcgaacagcgagcggatgcgctcgagatcctcgacggcggtgacgtcttccagcagatgggactggccgcgcacgatcagcgccgaatggctttcgcctccggcccaggtggccagaccggcctcgatcacccgcttggtcagcgagtccagcaggctgcgctgctgctccagctcggcggcgatctcgtccttgacctcctccagggaccggccggccaggcgggcgttgaggtaattgccggcctcgaccagggtggacatctcgacgccgtcgggcaggtcgagcaggcggttctccaccatgccgtcctcggtgaccagcaccaccagggcgcggttgcggcccagccagacgaattccacatgcttcaaggtgcgctggatcttgggggccaccaccacgccggcgcagcgcgagagccccgacagcgcgcccagggcctcgcccagcacctgctccatggagcggcccgccgcccggcactgggcgtcgatggccgaacgctcggattcggccatgcggcccacttccagcaggccattgacgaacaggcgcatgcccgcctgggtgggcaggcgcccggccgaggtgtggggggcgtacagcaggccgaaatcttccaggtcggccatgacgttgcggatggtggcgggagacagcgacagggtcaggcggcgcgacagggtgcgcgagccgatgggctcgcccgtctccacataggcttccacgatctggcggaagatttcccgcgatctatcgttcagctcggtgatgacggggcccttggtccgtggcatggcgctcttggggttttctccggtgcggcgaaaatctagtggcgccatgccgccccgtcaatgtcggggggtcgagattgtggacggcacccaccatatggaggtagcttgccgcacttttcccaatcctaggacttgcagtgatcatgagaccgtccggccgcgcccccgaccagcttcgcaccgtcatcctggaaaccggcgtgtcgcgccacgccgaaggatcgtgcatcgccaaattcggcgatacccatgtgctgtgcaccgcctcggtggaagagaaggtgccgcccttcctgcgcaacaccggcaagggctgggtcaccgccgaatacggcatgctgccgcgctcgactcatacccgcaccgaccgcgaagccgccaagggcaagcaatcgggccgcacccacgagatccagcgcctgatcggccggtcgttgcggtcggtcaccgatctcgccgccatgggcgagcgccagatcaagatcgattgcgacgtgctgcaggccgatggcggcacccgcaccgcctccatcaccggcgccttcgtcgccctgcatctggccttccagcggctggtccgcctggaactgctgaaggcgatcccgctgaccgatcacgtggcggccatttcctgcggcatctatgaaggcgtcgcggtgctggacctggattaccccgaggattccaacgcccaggccgatgccaatttcgtcatgaccggcaccggcggcatcgtcgagattcagggcaccgccgaggagcgccccttctcgcgcacccagttcctcgaactcaccgatctggccgaagccggcatccgccagctggtcgaggcccagaagaaagccctggggctgtcatgaccgcccgccggttccagggcggcaagctggtcatcgccagccacaatgccggcaaggtccgcgagatcggcgagcttctggcgcccttcggcacagaagtggtctcggccggcgccctgggcctggacgagccggaggagaccggcgataccttcgtcgccaatgccgagctgaaggcccgcgccgccgccctggcctcgggcctgccgtcgctggccgacgattccggcctggcggtggatgccctggccggagcgccgggcatctattcggcgcgctgggccggggccgccaaggatttcgccttcgccatggccaaggtccacacggccctgggcgaggagaaggaccgcaccgcccgcttcgtctgcgccctggcgctggcctggcccgacggccattgcgagaccttcgagggcgtggtcgagggcgacatcgtctggccgcccaagggcgagaacggtttcggctatgatcccatcttcctgcccaaggacggcgtcctgaccttcggcgagatggacgcggcggccaagcacgccatcagccaccgggccgatgctttcgccaagctggtggcggcgtgtttcggggcgggttgaggtttatcgggctatcgcccgaacccatccggggcatgccccggaccccctttgatttcatcaatggggtttgggacggcagcccatgagtcctcccggtttcggcatctatatccactggccgttctgcctgtccaagtgcccctattgcgacttcaacagccatgcgagtctcgccatggaccacgggcgctggcgcgcggccttgctggccgaactggatcatttcgcagcccaaacctccgaccgcattcccaccagcgtgtttttcggcggcggcacgccgtcgctgatggagcccgagacggccggagccctggtggatgcggtaaagagccgctgggccgcggctcccgacctggaagtgacgctggaggccaaccccaccagcgtggaggccgaccgtttccgcgccttccgggaggccggcatcaaccggctgtcgctggggattcaagccttggattccaaggcgctggcctttctggggcggcgccattccgtggacgaagccctggcggcgcttcggctggcccaggccacctttccccgcatgtccttcgacctgatctattcgcggcccggccagaccgaggcgcaatggcggaccgagctggcccgtgccctggatctggcgggcgagcatctgtcgctttaccagctgaccatcgaggacggcaccgccttcgcccccgcccatggccggggcgagttcgccttgcccgacgaggacgaggccacggctcagttcgagaccacccaggagatgtgcgaaaaggccggtctgccggcctatgaaatttccaaccacgcccgccccggcgccgagtgccgtcacaacctgacctattggcagggcggggagtggcttggcatcggccccggcgcccacggccgctttgatggctttgccctggcccaggcgcgctcccccggcacctggctggcccaggtggacgccaacggccacgccaccgagacccgttatgctctcgatcccgccgagcggcgctccgaactggtgctgatggggttacggctgcgcaacggtctcggccccgccttgctggccgaggtgcggcccgccctcgaccccgaggcgctggcccgcatgatcgaaggcggtttcctggtggaggacaccctgggcctgcgcaccaccgaccggggacggctggtgctcaatgccgtgctgggcgaacttctcgcctgagctactggaacgcgctgggcgccgcgcccacctcccgtgacccggtgggagcgatctccttgaccgtcaggccgcgttcagcgattccattggcgcccaggcggaagatgccgtccaccccggcaaagccgttgatgttctgcagccgggccgagccataatcgcccgtgccgttgcgaaccagggcggcggccagggcggtggaatcataggcgatgcccgccagcccgcccagacgggggggcagggcgccgaacgccttggcgtagcgctgctcgaaggcgacatgggcggtggcgggtggcgccggataccagccgccggccagagcgggctcggaggccagcctgggatcgtcccagagcaaggttcccagcaggcgcggcacctcggcgccgccctcgctcatgtaataggacagcagcgaggcgatgttcctgagccgcaccccgtcgtcgggcagcagcacggcgtcataggccgagccggccacgcccttggaggtcacgcccttgcgggcggcaaagcgcttgaccacctgggtgaagtcggtcgcggcgggatcgtaataatccacggccaccagctccaggccctgaagcgcggcggcgtccttggcggcatcggccacggcgcggccgtaatcgtccgagcgggccagcacgccgatgcgccgcaagccctgttcgcgggcatgggccagcacgcgggccacctggggaccgggcaggaagcccagggcatagacaccgctgcccgccaccgagcggtcggtggtgtaggccagcagcggaatggcctgatcgcggaccaccggcgccgcagccttgacctcgtagctgaacaccgggccgagaacgatgtcggccccctgggccatggcggcggtcgcggcggcggcggcgccctcggcggtgcccttggtgtccagcggaatcaggttgaacttggcatcggcgatttcgaacagcgccagctgggcggcattggacagggcctggccgatggcggcctgcggtcccgacaggggcaacagcagggcggcccgcacctcaccctggtgcgccgcccgggccggggcggcggcgggcgccgaatcggcgggaggcagagtggcgacctgggcctggggctcggtggcggccggtgccggggcgggagagggaaccggggccggccggaccgccggaagcgtcttggcggtggccggcggcgggacgggagcgggcaggggctgcgcctggggagcgggcttggttccgccggcccaaggtggtaactctgacgcttgttgacagcccgacaccatcagcatggcggcaagcaatggcaggacaacggcggagtgccggaaaaagccgcgacggcgcaaggggatcctcctcggacgacggccccggagcccttgagcccggcggcgagacagaggcaaaaagtagaccctgggcacgcggaagtaaaccgagcgccggcctttatctggtggccacccccatcggcaatctgggagacattaccctgcgcgccctggaggtgctggggcatgccgatctggtggcctgcgaggacacccgggtcaccggccgcctgatgcagcttctcggcctcaaggcgccacttgccccctatcacgaccacaatgccgacagggcccggcccggcctgctggcccgcctgcgccagggcgaggtggtggccctggtctccgacgccggcacccccatggtctccgatcccggattcaagctggttcgggattgtatcgaatcggatatcgccgtcaccgccctgcccggcgcctcggcggtcctgaccgctttgcaactatcaggaattgccagcgagcggttcctgttcgccggcttcctgccttccaagggggcggcacggcgggcggcgctgcaggaactggccttggtccccgccagcctggtgttttacgaatccccccaccggacgggtgaatccctggccgacatggtcaccgtcctgggggaccgccagggcgccgtcacccgcgagctgaccaagctgcacgaagaggtggtccggggctccctgtccgaactagccctccgcttcgccgagactccgccccggggcgaggtggccatcgtggtctccggtccccgggccgagggcggcgccccccaggatatcgagggccgtctgcacttagagatagaaaaaggcctttccatcaaggatgccagcgccctggtggcggccgaaactggccatcccaggcgcgatgtctacgccacggcactgcgactgttccgagggagcaacgaggaatgaattccgcgcccccttcacgcgcccatcaggccgcccagcggcgtggcaaggtggcggaaggactggcggcgctttggctgcgactcaaaggttatggaatcctggccaaaggcttgaaatccggccggggatcgggggcgggcgaggtggatctggtggcaaggcgcggcgatctggtcgcctttgtcgaggtcaagagccgggcaacccttgatcaagccattgaatctctgacacctttccagagacagcgcatcgagcgcgccgccgcggccttcctggcgcggcggcccgagctggccagctgcggcgtgcgcttcgatatggtcctggtagcgccgtggcgcctgccccgccatatccccgacgcctggagaattgattagggagtcttgtcggccgtacactggcccgacatcgccgtttatcaagggagtgatccgtgaccggggttcgaccactgctcaatgtcctgatcatcgccgccatgggtggcctgttgtccggctgcgccgccaccgtggtgggtgcgggagcctcggccggtgtcgccgccgccgaggagcgcggcctggacggcgccgtggatgatctgaaaatccgcactgaaatcaatcacctgtggtttcagaaggatgtggagatgtaccgcaaggtcaatctcaacatctcggaaggccgggtgatgctgaccggtgtcgtccccaccgaccaggcccgcgccgatgcggtgcggctgtcctggcaggcgacgggggtcaaggaagtgctgaacgagatccaggtgctggccgccggcgagtccggctgggaccaggccaacgatctgtggattcagaacaagctgaaagcccgcctactcaccgattccgacgtgaagaacatcaactacgtcgtcgacgtcaccgattcggtggtctatctgctgggcatcgcccagagcagtgccgagcttgaccgggtcatcgcccatgcccgcgacgtcagcggcgtcaagcgggtgatcagccatgtgcgcctgaagaccgatccccggcggaacggcggctgatgaccgaggccgccacccgggtccgcgcccgcctcacggccctcggccgggtggaggattgcgacctggatccggccgaacccctgctgttgctggccgccctggggcgcgccggcagcggcggccccctggacatcgctccctatctcgcccagttggacggcatggcggaggaattgcgggccgaggccgccgattgcggccatgccgaggccctggccatccggctgttttaccttttgggtcgccgccaccggttccagggcgacgagcgcgacgacgacgaccttggcgatctcgacctgctgaccgtcatggaccgccgtcgcggcggcaatgacgctctgggactgttggccctggccgttgcccggcgcgccgggatggtggcggaaggtctggcctttcccgcccatttcctgttgcgcctcggcctggccgacggcagccggaccatcgtcgatcccctgggcggtgggcaggccctgtcgacgccggatctgcgggccatgctgaaggccgcggccgggctggaagccgagctggagcccgcccattacgccgccatgagcaatcgcgacctgctgctgcgcctgggcaatgccgccaaattgcggctgttgcgcctgggccatgtggagcgcgccctggccatggtcgaagccttgctgctggtggcgccggaaacctgcctgctgtggcgcgaagccgggctgatgcacatgcggctcgaccacaccccccaggcggtgttcgccctcgagcaattcctcagccgcacgcccagcgcccaggccaaagcccgcaccctggccctgctggccgagctgaagcgccggatgcactgacctccccctcctgatttaaggacccgatcatgagccttgccgtcgccatccagatggatcccatcgagtccatcgacatcgatgccgattccaccttcgtgctggcgctggaggccgagaagcggggtcacaccctgttccactacctgccgcgggatctggccctgcgcgaaggccgcgtgctggcccgggttcggccgctgagcgtgcgtcgcgccaagggcgaccacttcaccctgggggaggcccgcaccgtggatctgtcgtccatggatgtggtgctgatgcgccaggacccgcccttcgacatggcctatatcacggccacccacctgctggaccacatccatccccgcactctggtggtcaacgatcccacccatgtgcgcaattcgccggaaaagctgctggtcacccatttcggcgacctgatgccgccgaccctgatcacctcggaccgcgagcagatcatggatttccgcgaggaacacaaggatatcatcgtcaagccgctgttcggcaatggcggggccggggtcttccacctggtgccgggcgacgagaacctcaattccctgctggagatgttcacccagatctaccgcgagccggtgatggtccagcgctatctccccgaggtgcgccagggggacaagcgcatcgtcctggtggacggcgtggcggtgggcgcggtcaatcgcgtgccggccgagggcgaggcccgctccaatcttcacgttggcggcacggccaagccctctatcctgaccgcccgcgaacacgagatttgcgccgccatcggcccgaccctcaaggaacgcggcctgattttcgtgggcatcgacgtgatcggcgactacctcaccgagatcaacgtgacctcgcccaccggcatccagcagatcgatcggttcgatggcgtgtgcatcgaaggcctgatctgggacgccatcgagcttcgcaggtcggtttagccttctgggctaagggaccgggtttccacgtttattgccctgaaatcactccaaatgcagttgcggcccgaggttattgcggccctgcgactgcattcggagttgggaaattgcgcccacctcggcacctccaactgcattcgcggttagccgtagtgccccgctctcgatgaaaccgagcttcggctgaaccgttggaatgggaaggcctgatcgataggcttttgctcctattacatggactcggccggcgccgggcccggcaccatcgggccaggggccatgcgcatgcgctaccacctgtgggcgattgcgccattttcgccacataaggcgaagccatcgcccccgccggggcaccggccctccatctcccccaagcctcggccttgggcgcacccgtcgcccccagcaccggatgggagcaccgccctgtccggccccccgccatgcctcgggtcggcagaagcggacgaccctgtccggccggaccggttaccagcccggagcggtcggccgaactgctccgggcctgggtcattttggctcgaatcgggggaccgggggccctggccggagccatcgggactttccctgatcctgcgggcgaaacgaaccccaggccatggccggtcgaccggtcggtcgagaaacctcactcgcccacaggttgctttcctcggccctcgtgggatcgaacgggaagcgctagcgctgattgtatgcactgtctatgattgcccgcgtttcaatgggattccggcagcatgaccacccgcgccaataccgtcgccttttccggcatcgactgcctcgacatcgacgtccaggtgcaggtggccgccggtatgccggccttcaccctggtcggcctgcccgacaaggcggtgggggaaagccgcgagcgggtgcgggcggccttcaacgccatcggtctcgccctgccgccgaagcgcatcaccgtcaatctggcgcccgccgacctgctgaaggaaggcagtcatttcgacctgcccatcgcgctcggcctgctgggcgccatgggggtgattcccgccgacgagatcgccggttatgtggccctgggcgaattgggcctggacggctccatcgccccggtggccggggtgctgcccgccgccattgccgccaatgcctcggaccggggcctgatctgcccccactcccaggggtccgaagccgcctgggccggcgaggtcgaggtgctggccgcgccgtcgctgctggggctgatcaatcatttcaagggcagccaggtcctggcccgccccgccccccggcgcatggaggagagcgggacattgctggacctcagggacatcaagggccaggaatcggccaaacgcgccctggaagtggccgccgccggcgcccataacctgctgagactcagcactgcaaaactaggctcggactttggagagctgatccaccattccatcgacctgccgcacgtcaccaacggcggaacgcagcatctccgcaaacacccgagccactgccgccggatcgtccaccagccgaatgctcaacgtccggtcaggattgaccaccacctggtgcactaaattcctcacgacgaacaccacgtccgcctcctggcccgccccggcctcggtcgccgtcatgctcctcatgccggactcgatccgattgacgatcctgtccagttcggccccactcacgataacgcccgtgtcgagaagggacttctgatccatcagagctgagagagccgaggcaacgcgctggcgttcggcccttgccttgtcgttctcggcgactaagtcgggaacgctcgcctcttccaccttcattgtcgcgagccgcccaagaatggcctgcttttccttccacaccatctccgtcctggccagctctgcttccatctgctcgatattctgcgtgagctgccgctggtcacggagcgactgacccatgaccagctccctgatcttggccgggccaccgatgcggttctcaatgaagcccttcaccgcggccttcacctcgttgtccaccttcaccatctggagatacggccccttgcaaagcttgccggttttgcgagcgtggcagacgtagtaatgcacacccttggagtcggtgtggaaatagttcttaccgcaggaaccacagacgattttgctgaccaagagccacggggttatcggacggcgaccccgtccctcaccgggtggctggccagacttcatcctgatcttcttggccgccgtggcatcgttaaattctgactccgtaacgattgggccgccgtggatcacgagcttgatcttgtccttcctcgtggccgaccaaagccaaccacaagcggcgctgttgtccagaacccgagcaaccgttctcgactgccattctggaattccatctaccctggcaccgttcttttccagccacgcggtgaacgcgcccacgccaccatcggcctctatcaaggccggtcgcattctccgggtggtgccgtccgggagaaccaccttcacctcgggcggcggcacccgatcttggttcagactgcgggcgatctgagtccgccccatgccgccggtggtgcaggagcggaagatgcggcgcaccgtctcttcctcgcctggacacttctccaaggatttgtcagctcgcttccggtacccgaacggagcctggccattaacgaataccccggtggcccgctggcgctctttcggcgggatggtgcgttccttcatgcgctcgatttctcgggctgcgattgcagacagcacccccaggcggatccgcgaccgccagcggcaggccatgtccgccgacgacgtgaccgtcatcagcgatgacgaggtggacgaactggtcgccatggagcgacagatcgccgccgacgccgccgagaaggaagaaatccgggccgccgcccggcgggaagccgaacagcgcaaggtcgaggccgagcggcaggaacgccgcaacaccctcggcaacgccgcgccgtaccgccgcccgtcgtctttgccgggcggcggcttggacctgatccgcaagggcctgggtcatgcctgacgtccaggctaccacctggcccgcgaagccgccccgccaccacatcggcggggcgtctctcgttcgtatggacgcttcctggcgatgaccacgacctcgcccacctcccggatcggactggctggccttgacgccaacatggttgaccgcatcgagcggggcgagttgacgcagaaagaggctgccgacctgttgggcgtaaagaagcaggccgtcaataagaagctgaaagagcttcgagagcaggcgggagctactaccccagcgcccgcaccggccaaggcccttccagccccggcggatcgcgctccagagtcccaagcgcagcctggggccgctgcgttaccggcgtcctctcgtattcaggaagcggatgcgcttgaggccgaaatcgagaaatgggccaaaattgggggcgatgcatggcaagggctcgccatcggttatgcgaccctcataggtcaaacgaacctttttctaaaaaaaagcatcgaaaacggtgggccggggccggtcgccatgaatggtatggtccgggcgctccgcgagagcgaagagggccttcgtcggctcgggctactgcccgccatcgccggtgggaaccagggcagcgaccagcccgtcggtttggtcatcaccgttctcagtcctgacgaggaagacgagatccgagccgagattgccgagcgggctggggcggatctgacgaaagaaaccctgccgtcagccccaccgcccccggtcactcctggtcggcccgtcgccctgatcgaccgactgcccgaggccaaggacttcgaggcatggattgccgccatgcttcacatgaggggtgccgcatggctgcgtcagatcgtggccgccctcggcggccagaccgcccacagcaaggatcaattggcatcggagttaatgcgactcacttgcggcgacccccagcgccttcagcaccttgtaggagagcccgcatgatccccgaagaaagactcctctggtcggcgatcatcgcccaggccgtcaaggacgcccgaggcgagagcagcaccaacaccggctctctcccctggccggaatatgacgccaagtcggaagcccttgcctggatattcggcgacgacacgggctttgaagcggcctgcgacttcgcggacacgcatcccgagtgggttcggcggatggtctttgcaacgccatgtcgcctccctcgtcgagccgcaggcgggtggaaagcccggaaggcatgccttccctctcccgacatctccatgcccacggccttggccgcataaccaacaagaagggtaacgaccatgaagctcgtcagcgtccttgacctcgacaccagttccttccaggccggattgaagacggcggacaacgccgtccgcgtcttcgagcggtccatcggcagcagctccaccgccatcaaggactttgccacgctgctgggcggcatcggccttacccgcatggccggtgaagcggtcatggccggtgacgagatgatgaacctccagcggaagctgtcggtcatcgccaacagcctgaacgagctggcgaaggcgcagggccgcgccaacgaggccacctacgacaacgccaaggtctatgccgggctccgcgacatggcgatggagacgggcacctccatcaagtcgctgtcccagatttacgtccagaccatcccggtcgccaccgccctcggcgtgagcgtcgagaccgtcaacaaggtcatcaagggcacggtcggcgcggccgccatgatgggggcctcccatgtcgagctggagcggtcgttcgtcgccatccgtcaggtcattggcaagaaccagctccagatggaggagctgaagcgtcagttgggcgaggccctgcccaacgctatggtcatcaccgcgaagggccttacccgcatcgccaacgagtcccccgacgtggcccgccgcctcgaccagatcgccgggaaggcgaagatcaccaccgtggagctgaacaacctcgtcaccaccggcaagatcgacggcaagctgtttgccgaagcctgggccgccgggaccgaggagttccagaagtacgccgaagcccgctccaagaccctctccggccagatggtcaacttcaagaccgtcatggagtccaactcgggcatgttcatgtccgacagcgggatcaacaccgccctcggcgtggccctcaagcacgcgaacgacaacatcgacgcctggatgaaggtgcaggtggcgaaggcccaggccaacgggcaggtgttcatcaacagcttcctcaacgtgggcgacggcatcgccaagcacctcgaccagacccaggacttccactctcagatcggcggcaccgtcgccgccgtggccgacaccacgttgaggggggccgagtccttctggcgaaacttcccgcccgaggtccgcgagatcgggctggtgggcatgctgttcctcggcaagaaccgtctcggcctccccggcgtccttgcgggcctgaccgttcgcggtgcgggcttcctgaccgcgttcggcctcggcctgctggacgagatcatgcccgagcgggcaatggcgaagggcttcaaatgggggtacgacctgatcgcggagatggtcgatggagccaagaccggcctgtcgcaagtcggcccggccctgtccgacgacatctccaagctgttcgaccgtcgccaccgcctgatccagtcgcccctcacccttgccaacgacagcgcccaagcccccgccggtcagtcctatgacgacacgaggaacgccagggcgaaggccatggacgaggcgaagcggaaggacaccgccaagtttgtgggcggcaatctctccagggccatggacgaggcccaagacgccctcgactacctcaccttctaccagaagaaatacgaggacatgggcgacgccggaaaggcgttcggcaaggtcgtcggagccggtgccaacatcgcggactcctggatcgagtggaccaccagcctgggcggcctgctgggtgatggcgtccgcatgttcgagcccgacgagggcatccgggcgacccagaagttccagcacgcctactccgactggaaggccaagttcctcaaggacttctccgaaaccaccatggcgctcaaggccatgtcggaaggcggcggcctgatcgaagacatgcgcccctctggtgcccttcgcaacaccgccatggagcaattgcgcctgggcaaccaggccgtctccctctacggccagtccctcgcccagtccgatccctcggccaagatcatgtcggatcttgagcgccggatgagccgcatccgcgagatcgaccatgacctgaagctcaattccggcacctccctggaggagggctgggacgcccttccgcagttccgcgaccggggcattaccggcgctcgcatggccgaagtctcggcggtgttccagggcaccatgtccgaggcggccaagcccgcccagcgcgacacgctctccgacaccatcgccgccaacgagaagcagatgggcgtcttcgccaagatggccgattgggtcgagaactcggcggacgtgcccgacagtgccaagcagcagttccgggacaccctcgggcaggcgatggaacggttcgggcgtcagctctccatcaccctcgaccaagtcaaggaagccgagatcggcaagctgaccttcgaggccaggaagaccgaaggccgggccgtcgccatcgagcgcagctaccaggaagccgagacggcctatgtggagcgccaactggcgaagctcgacaagaccggcaccatgcagaaggtggtggacgcccgcgccgcccgagagcggaaggagatcgagaccggcgcccgtgatccggcggccaccgccaacaccctctccgataccgacctggacgccaagcgcaagcagggcgccaggatgcgccagcagttcagccagcagcaacaggccctctccctgaccacctacgagggcgaccgcgtgttcgcggcgacgttcgccaaccagcaggccctcatggagatgggcttgatgcagaaggccggttatcgcgggctgctgggcgatggccgggaacggcaagttcagctcgccaccgagcaggccaagctggagttggagctgcacgaccgagactcctaccgggccgccctgatcgaccaggagatgaccaagctccggcaggaagagaagacccttcgcctccagttggaggtgtatgccaatgacggccaccgcgagcagatcatccgcaacgagatggcgaagctggatctggagatggcgaagctggccgaggaacgcgccctctattccagccccgaataccgggccaagctcgacgcctcaacccacgccaaggccgccctgcaactgaccaagacccaggacgagacccggctcatgggtaccggccagtaccgcaacgacacccagaggcaggcgtatgccgagctggcccgcgacgcccagaagctccgcaacgagatcgacctgatgcggacgggcgaatggcagcggaacgacatggcgaaggcccggctcgacctggagcgacagatcgagcaggtctaccaggaccagcgccggtaccagactgcggctttcgtgtccgagatgaaccggctcgacatcgagaaggcccgcgtctccaacctggacaaggcccgcaccaactcgaacatggagagccccgagtatcaggccgtccagcaccagtccaatctgttggacctgaagcgccaggaggtgcagctccagcagcagctctacagcatgcaggatgccgcctatggggccatgctgaactccaacacggccctccaggggcgcgtcgagatgatgcagctcctcaacagctacaccatgagcttcacccagtacatgcagaccggagccgcgtccgccgtccgcacgttcaccgacaccatgtccaacggcatcgtccaggtcatcaccggccagaagaagatgaagtccctctttcaggacatcgcccagttgatcgtgggcggcctgatcaaggccgtgatcgagttcggggtccgtatgctggtggccaccgccctctccaagatgttcggcatggagctgaaccagaactccgagcagagcgttgccgccatcggcgtgacgacggcggccagtgtcgcctccctggctgtcaccactgccggcggtatgctggcggcctccatgctggccgaagcctgggcgctcccggccatcctcgcctccatcgccaccttcggggccgccgcggtggtcggcacggcgtcattccttggtgccctggccgtctcccagatggcggtggcgggcgtcaagggcatcggcagtgccatgggcgagggcggccttgccaacgctggggcgaactccgacatcgccggttcgcccggcatgatggaagcctttggcggctccttccacaccggcggcatcttcgaggccaatggcagctccaacacctcgttcggcggaaccaagctggcctccgacgaggggtatgccctgctccagcatggtgaaatgatcgttcccaccaagaacgtggcggcgaccgtggcggccatgaagatgagcggtattcctctccccgaaggggtctatcacaacggcggcatcttcggtaattcagctcccttcggggcgctggagagcaactggcaaacgcccaatgccagcgaccttaccacccctggcatgagcgacatgtcgccgtcggtcgtccatcgccccttggcgatcaacgtcatctccgtactcgaccccgccgaggtggatcgacatatcgccaggaaccccaacgccactctggcggcagtcagcatggactaccgcaacaacggggtgatgcggaagatgatccgacagggccgatagtatcccggccatcgcttaagcgtacttcacgcttccggtcttgccgcacttgggacacgtcggcttgagtgcagcaaggagatcctcgggcatctccttgctgctggttatggtcaggctgcccccgctgaaaccgtcgaggctgtagcactcccacaagctgctaaatggctggtcgttctccgaacacctcagatagccctcgtgcccgcattcacaaacgatgggctccttcgtcctcgttgtcatctgccccctccttcatgcacatggcccgcccttcaatgtacaggaacaccgagatcgcggataggtagggaagtcgagatcgcgccgcaagcatggcgagaggcggttacctcggcatcgtgatgcccggcacccggtcataggtaggcttgttcagatcgggccagaaccgatagccgccggttccgtccggcaccagccgcccttggcgctcccagcccctgtagacctcatagctcccgtcctggcgaccgctgggccgaacctcgacctgtcgctcatgcctgaacaggtcgggcaccaccggcttgggcctgtcctcggccatgacgccggacgacaccgacagcaccagcatggagacgaagatcatccgcaaggtatccatgtagacctccataagcagctccgcgccatgatcgctccagactacaggtattcgcaagactaaccgcaatcatagcgggttcccagcatggaaaatacctgtcatacaaacagtcaacgagcgttgatagtttgtatgaccaaggagaacgaagatggcgaccggcaaattcattgcttactaccgcgtctcgaccgacaagcagggcaagtctggtctgggccttgaagctcaacaggccgccgtccgcgcctacctcaacggcggtgattgggatctgctggccgagtacaccgagatcgagagcggcaaacgtgcagatcgtccccagctcgcccaggcgctcaaggccgccaagaaggccggggccgtgctggtcatcgccaagctggatcgcctcgcccgcaacgtcgcgttcatcgccaacatgatggaggccggtgtggacttcgtggcctgcgacaacccgcacgccaaccgcctgaccttgcacatcctggcggcggtggccgaggatgaggctcggcgcatctctgagcgcactgttgccgctctccaggccgccaaagctcgcggcaaggctctgggtggccgtcgcactgaaggccagtatgaggccagttccgcaacgcgcatggctgctgccgatcttctggccgcgaacgtgaggcccatcatctccagcatccaggcgtccggcgtcacgtcctatgcggccattgccgacgtgctgaacaccaggggcatcaagacggcccgtggcggtcagtggcatgccagctctgtccgcaacgtcgtgctccgcagcgcccaggcgtaggccaagcaaaaggccgccggagcgtccccggcggcctgctggtcaaccccgagtcaacctcgggtcaactcgtcacgctgcgatggccgcgacatggcgaccgccaccggccagctcaacgacggtcacgtcggtaacgctcttgtcgtcaaagccgaacgagccgcgctcgatcatctcaagaagaagatcaacacgttcagcgctcgtcaggttcgtatcgttgaagcggtcgtcgcagaagaagatagcaaacttcatggcatatacctctctaatgaagatgtgttcttgttgtgcatgccttctatcagagcaaaggcatagccgcaaataagcgcacacttacttatgtcacgacagcatcgtctgctgcataacttgatgaaaatgtcaatgtgtttaattttttcttgagcgaatatttgcgtaccgtgatctcgagggcgcaccccggcccatgaaggggtcagcggataaaaaagagggtgggtggtaccggccggagggtggtcctctcattgcccggcccatgtcgaaaacggtcaacctgctggtggctggatatggatctgaaccccggtccagaccggctcgaagtccagatccatggcgcacctactgcgccagcttcatgacgaacatcggatcgaagatcgcagcgcccccaccgccgccgagcaccaccacgggacaattgaaggtatagcccaccttctgcgccgcagccacgacccccagctttcccgtgtaccagcggattggctccttagtcggcacaggaacctctccgtatgtagcgaagctcgcgtcgctggcaaccacctccgaccctcgcggcagcttattggcggcgtgcaggatgcacttcttggcctccagctccttggtggcgtcatcagcctcccccttgacccccttgacccccttcgcccacgccgtccccacgactcccaggaccactaggcccgccaaaatccccttgagcatcacttactccacatatggttgatgcccaagcctagcgtgatcgctggggtctgtacacccgctaggcgattttactcctatcgcccctcgtatcgctcggcatgcccggcgtggcgtcgccagttctcgacataggcccgcgccacgtcctcaccggccaagatcacgacgttctcagcgttgcgctcttgggcggccttggtgaagttgaagctccccgtcagcacccggcgcccgcctgtcccttcttctgcccgagctgactgctgtcgaggatcacgcgcacgtcaacgccacgtcgccgggcgtccgccagggccttggtgatctccggcgacgtgaagctgtacgcctggaccagcacctctcgtcgggcctgcccgatctcgcggacgatcacgccggtgcagtcctcgccaggggtgaagcacaccccggcgacctcaccggcagcgaccggcattgactcgagaaccaagccgaaagccagagccagcctcaaatttgctattcgcattttgccacgctatcgtgaatgtgattgaggccgagcgttgacgcgcccggcctcggtgcacagtgaggagccacactgtgcgtggattgtatccatgtatcgaggagtctagctgatctcctcagcccgcgcaaatcgccctggctgtgctccctatgacgacgaggagcaccggcatgactaccgacccaaccgaacctaataacttgcattctgcggacacgcaggccatgcaaaattttgattttctcaagtacgtcaagaggttcgccaggaaaccccgaaaccgaacagtcttagaagggatagacacctccccttcaatccccctggaagaagacctctcccggatggcaagagccctgtcgagcatctcgtgcaagacccggttctccaatcatgacgaccacgacaaactggatctgtgcgctggcgccgccttgctccacgatccagacctgaccggcatggccttcctgtccgtgaacctgatcgagggcgagaccaccgcctcggccatgtcggcaatccgcaagcgcatcacccggagcaacggcggccagagcgcccggtacttcggcgtgttcgtcaactactccagggtgaagcacggcaggaacatccgcttcgaccaccaccctcatcttcacctggttgtcctcgactgccccaagggctccgacacctacaaggccctcgaaggctattgcaggcagcggggcaagaccaaggcccctcggagcggcaatatccaggccctcgaccatgatctgtcgtggacggtcggctacctccgcaagaacctgaccgagagcggagccgccggtctgcaacaccgggatgaggtcatcatttccgatcccatccgcgacgtggccgaagccatcggtcagggcaagatcgacatggccgagaaggtggtggcgcccaagactcagccggtcgaaattgagacgcggaccaccccctctcgaattcggccagaattggagagggatgccccggtgatggttcgcgtcgtccagaagctccatgcagaaggtgcagatcgggccgaagctgtccgccgtgttctcagggcctgggtagagcttcgcggtttcagtctatccccggcccgataggctttattccatgagggtgaattgactgtgccgccatcatggctggctagcccctgagaaccctttctttatccactttcccagaaatacggcaatagaaccgaaaatccatatcgccaatatcggcgatatgatcttcttaatgatcatagcgtgcctaatatcaccaaggcgctgatcaatattttcaagttctcgtttcatgcaaggttcgaatttttggctattgttgcgcacttctgaattgcatttatctgaggcatcaatttcaatttgatctgacaccatcggcattagtcgataaatactaatactgccgtagagacatattaatgccgaaccaataacacctaagcgctgccatcctgttaatttcatctgtaccatccttatatatagtttctcacctctatcgcattctatgatgtggcaaaatctcttgctatgccaccattcagttacatagcaccgacataccacctctgagaatagccgggtgggcgcgagggcctgatacggacctcctgactcccaggacgggccttacagccccgaagccattcacgacatgtcaatgtagacggccagcatctcgggccttacagggggccggaaatcgcatctagttttgcagtgctgtatctgctgatgatgggaccgcccggttcgggcaaatccatgctggccgccagactgcccggcttgctgccgccgctggagccctccgaggccctggaggtcagcatgatccactcggtggcggggcaattggccgagggccggctgctgacccggcggcccttccgcgatccccatcattccgcttccgtgccctccctggtgggcggcggcatgcgggcccggccgggggaagtgtcgctggcccataacggtgttctgttcctggacgagctgcccgagttccacggtattatggagcaaacacaccaagggcggtttgcctctgctggggccatgacgctaccctgcagccatggcacttcctcacgtcataaccgccctcatggcaaaaagagcagaactcgctgggctgctggagcatcaccaggccctggttcggcagacgattatcgacctcgataacgtggatgccactctgcgtctgttcgatgccgacatcgctctcgaagaaatcaagcccaggccgattccgccacgccattgcgcttataaaggagaggtggcccgaatctgctttggcagcatgcgcgaggcaaatagaccccttacgaccgaggaattggccagacacgtgatggccgagcgcggcatgaacctggaagacaagcgtctcaccaggtcaatcgtgaagcgggttggggcatcgggcccgagccggcatcgatgatcccggcgcgagctagataaggcaggacggaataggagttgtcagagccgcaatcctgcctttgaaggatcaccggagacgagagtgcgagcgctccgagctcctggaaacggtagttgatccacatgtcgacggggccgatgaccggcatcgcgcgaagcagcgccgcagcaccctcgcgggacagcacgtagccggacagaaaccatagtccgcgcactggccggaagagagcttcgcagggatcggcgcgattggccgtccctccggcgtccgcgtaggacaggtaaagcaggcgcggtccgccttcggtgcggcatcgttcgagggcggcgcaccagccacggtcgatggcagcagccgcaccgggtctgaaccagacgtcatcctcgagcaccaggacgtgctcgtgctttcccgtcgcgacagccttccagacctcgatgtgagacctcgcaaccgccacctcctgacgcgtcatgcggactggctcatcggcgctaaagcactcctccagcctcgcatccggttggacgtggagttggttccccaggcggtagttcggatcgacgtcggccgtcgccgccacggcgcggccgtcacgtgcgtccaccgctgcgagtcgtgtcgtgatcgatgtgagatgatcgccgtcggaggttcgaaagcggccgagttcgcggagcacccgacgccacctcgccggctgccggtcgaggttcaagatcaagatcgatccgatcctgtcgggccccgcgccaaaggcagaaatccgaccaccgggcagcgctccaatggcgacgcgcagagcgcgaaaggcgaggctgcgcagcaggccggaggcttcgtggaggttcataggcttaatccagcgtccatgttgcgccagttgcgcgcgtcgttgcgataggagaggtgccagcgagtctccgcgatggcctcccagtcgcggagcaattcgaagtcgagaggtgttccggcggcgatcaggttgcgcgcgtgggccgccagggcggccgtgaggtttcctggccccgtcgtcgtctggatctcggggcgctggtcctcgccgagcagccgatcggttgctcgagagagcgcaactcgcaggacgggatgaccggcgggtgccgcgatcgggttattgttaacgtagaaaatgcgcccgtgggtacgcaaattggggcgccaaatttcggcggccggtaccatacgcgctgacgggatatcgtagcacagcggctgtaccttcagccgaccatcgccgaacaactcattccagccatctcccagcagcatgtcgtccgcatcgacatagagtccgccctccgcgagcacgaagcacatccgcagatagtcgctgcgcatcgcggggtgtcggcagcgcgcgaacgcctcgcactcgcgggtgccgtaatgttcggcaatgtacgccgccgcactctcatcgcagaacatacggacctcgaagccttcatcgacgaggcggtcccagcttgctaggcagtcgcgcacgtcgtccggcaggtcacttgggtcgtgccagtattggatcagcgtccggggcaccaccggcagttcgctcgcctcggaagaccgtgggcactgaagcagatgcagagtaagtttccggatgaacgcagagcgcagttgatcgctttcctcgaatccggggggataggcgttcattctgagtatggccttctgtacctgaggttcggattgggcggcgttgaccccgttgcccatgtaaccggactacgcgctgctggccccgcgcgcaccggggaccggcatagcggacactttaagatgagcctgatagcgttccgagctcttcagcaagtgcgcccgtccgttaaccacgaagccgtcgaggccgtgctggacagcgtaagcgtcgaggtcgccgatgttgttgatgaagcccttcccgctgaagttcagcgaggtgttgcacagtaccccgtagcctgtgcgggcgctgaacgcggtaagtaggccgtagaggttcctgttggaggcaggcgtgaccgtctggatccgggcggtgccgttcacgtgcgtaacggcggccagcgcgtccgtggtcgatttgtacgtgtaaagcatgtacgggctcgcttgatggcagccaaaccatcgcgcggcgtccttattcaagcagacgggcgcgatcggacgaaactgctcgcgctgcttgatcacgtttagccgctccctgatgctgtcgtggaacggggcggcaaggatggacctgttgccgagcgcgcggggaccaatctcataccggccgctcacccatccaaggacgaggtcgttggcaagcaattccgccacctcactgtggtctatgtcgtagatgtcgtatcgccaggagtcgaacgtcccgccggactggaatgcgagcccagagtagacgtcccactcgatcttcggatttccggtgaagtagaattgcgcgtcgatcgctgtcccgatggcggagccagaatcattggcaacggggggcacgaacacgtcggagaagaagcctgtctccttccacttggtgttccagtcgcagttcaggccgcaaccgccagcgatcactaggggctggttcggcgtgaggttttcgcgcgcataggcaccactaaggcatcaccggtggcttgagtagaagcctgtttctaaagtgggccgcgggcagtaagactggcgggcgtcaggttcggttagattctttcagtctcgtcactgccttagcccaaggatgacgcctagagaacctatcccttaccgatcagccctgctaaggcgatagacccggctttcggccacagcccagtctgtcgcctcatctaccgacgatgccgcggacggatggtcgctggcgagccaatttcctccagcgagaccggctgattggtctctccatcgggtgagtgcgtaagtcgagagggcctcggcaatgggctcctcagcacgtgtggctggatcagcgtctcgatgccgatgctcgacgtggaactgctggttccaggcatcggcgtgttcgctaagtgcggagtattctgcatcgattctgcatcctgtccgttaaggtcggttctgtccagacgatgaattggcctcagcaacccttcgagccgttcgtcaatcaaagggtaggcgcgagataaagccccactgaccggagttcacctggccctgccgagacaatagacccggctctcagccatggcccaacctgccgcctcgtctatccagaggaccggagacgagcggaaagtaaacctttcggggtcggcataggggtggttcaggcatcggcctcgcaagacctcgaagatcccttgatcggttttgatcacaccgaggcgccagtcctcgatacgggcacaccgatcaggaacgcccggtggcaaccaatccagcggagccccgcgggcagcacgttgatcccgaccgccattgttgatctgctcgcggatcgccagggcgacaatgcgcaggggctcactcagaatgtcgagtgactgccccagttgatcggccagcaggtttcgccagagcgtcattcttcccatgatcgcgccatgccgggccaagccctcggcggtggcgccatcaatccgacgcccaaggccacgggccagaatctgggccgctaccggccaatccggcaatgccgggggaacaggctccatttccagaccgttgccaaaccagcgcccatgatctcggtcatagcccaccgtccttggaaacagcggccggtcgagaagaccacacaggtgagcggcgagctccgatcccaccgccagcctccagccgtgctgccgggccaacgcttctgcgtagagggcgggggccgggggcaaatgcggcatcggtgaaaccactccgaaggccgccagcagatcatcgcgatcacgctcgacatagacgtgccgcgacaccggtgaaatgtggcattcgcgcagggctgtggcgatctcggcggatgtaacgccggcggcctgcagttcggccaatgccacgggcgccgacgtgaaaccgtgattgcccacggcaagggccaatctggttggttcggccaaatcccggttcttgcggatggcgctcaggatgccgaagagcggagaagtgtcgtccatgaccctcccctccagaggcaggcggaagcggttcattctagtcatcggtcgcctgtttattgccgtccgatggcaggaccgttatcgcctggccttcgtggatctcgacgcgggccaactcgacaccgcgatggaggaggcgcgttgtcgtggaatgctcaatggctcgctccaccgccatcacccgcgcgtcggattccgtgtagtacgggaccggcacccagacatgggcatacatgacgccgggagcggcctcgatgatcagcacatatccgtcatcggaatcatcggccggccagaaccaacgctcctcgggcagtaccgcacgccaggccagcacctcctcggccgcctccaagagcgcgatctttttaggattgcccggttcatccgccagcagggcgcgacaattgtcgcggtagaagagccagtcttgtgtcggcgccgatttcgacggcggctcgatgaggacgctccggccctccgacggcatcaccgccggcaacccatctgggtgtagccgccacaggctttccccggtcgtcgaggccggttcgcctgtcagggtgctcattcggcgtcgccgcagttcctcggcggataggggcccattcatggtgtcaccctctcgcaggcatctggggtctcatgcttgccccagctgattggcttgtccagggccgcaactgggttccgcatgcgtcggacacatggcgatgaagcaagccgctgaagtgagatttatttcgccttggcaaggaatttggcacgggtagagccccaggctcataggcgggtgatctcggtaaagacctgatccagatcatgggccaccaggatcgcctcccggccgccgtggatgacgatcatcgcctcggtgcgatcctcatcggcatccctgagcgctgagatcgaactcagacgcacggcatggcggatgccctggatatccgtcacgcacaaaaaccccgattcccgaaccggctcgttcatccctagcctcctgctcaagcagaacactagtggaacatgtttgatttcaggccgctaggggcgtcttggtgtgtttgctccataataccggagttccagcggggcgccctggaagccctgcgccagcccctggaatccggccgcgccgtggtggcccgggccaatgcccacgtcacctatcccgcccgcatccaactggtggcggccatgaacccctgccgctgcggccatctgggcgacccggccctggcctgttccaaggcgcccaaatgcggccaggactaccagtccaagatctccggcccgctgttcgaccgcatcgacctgcatgtggaggtcccggcggtcagtccggccgaccttgccttgccgccgcccgccgaaggcagcgccgaggtggcggcccgggtggccgccgctcgcgccgtccagctcgaccgctatcgcgatgcggcgatccgtaccaatgcggaagccgatggcgaattgctgatgcgggtcgcttcgcccgatcaggcgggaagcaagttgctggccgaggcggccgagcgcatgcgcctgtcggcccggggctggcaccgcgtcctgcgggtcgcccgtaccctggccgaccttcagggcgccgagaccgtcggtcggatgcaggtggccgaggcgctctcataccgaaggctgatgcccggtcgcgcggggtgagtctgatcgccctatgacctttgtgggcattgcgcctgttgcgtgcccggcgccatgctccaacagccggcgagaaatggggtcaagacccgatgagcacctgcgcgccttcccgggacaagcggcgttgccatgatatggcgatgatcgtcaccgatgtgatcatgaccctggcccgggaaaagacccaagacggcaaggtttcccttcacgacctggaacgcatcgccgccctgatcagcggcggcagcatggtcctcgacgccgcctatatccgccaggaggaatcgtgccgcaagttccaccaattgcccaagggcaatgtgggagcacggtccaatcccttccatcgcctgatggtccggccgttcgaacacctgctggccggcgacggcgccgtgctgcggcgcgaatatctgccccattatttcgagttcctggaccacgccctggaaaagcgcttggaagccttcgagcgccactgccgcaccatcatccaggcgctgatggtggtacacggcaacaacctgacctgggaccagttctatgccgatggccgcaccatcaaaaccctgcagggcgcgctgaagctgttgcgggcctatatggaaagccccgaaggccagcgggtctggcacggctgcatgatgcggcccatcggcgacctgcccgcccccgccatggctcaggtccaccatatccatcaagttctgctggaaaccgcccgggggctggaagcggcggaataggggccaaaggccccaaacccattcatttcattttgaaaataaacggagggttcgggaggtatgcctcccgatggggccggggcaaagccccgtctctaccctaggcgcccgtcttgggcagcatgtgaccgagcttgcggccgccgaagacatggatgtgcagatgcggcacttcctgatggccgttctcgccgatattgctcagcatgcgccagccgtcggcggtgacgcccgccatctcggcgaccttgcccaccgcccgcaccaaggcggcgatttccacatccgtggcccgggccgagaagtcgtccatggacacataggcccccttggggatcaccaggatatggacgggggcctgcgggttgatgtcgtggaaggccagggtatggtcgtcctcgtgcaccttcttgcaggggatttcacccctcaggatgcgggcgaagatgttgttggaatcataggccatcgcttgctcccttggccgaaggtgatcacttcttggcgcgcgacttcttctcgtcgatacccgaggtgccggtgcgccgggccagctcggcccataccttggccggctccacgccgcaatcggcccacagcaccagcagatggtaaagggtatcggcgctttcgcccaccagttcatccttgccctcggacagagcggcgaccacggtctccaccgcttcctcgccgaacttctgggcgatcttgccgcggccgcgggcaaacagcttggcggtataggacttgtcgggatcggtgcccttgcggctggcgatcaccgtgtacaattcctcgagaatcttgctgtcctgcgccacggtgccctctcttttaactggttccagaccgtcatctttcccaacgccccctgcctaacagatggcggcggggctgtcaccccccccgcaagggcaccccttcaggggcggacgggaatcccggcggcacgcatgtgcgccttggcctgggcgatggtgtaggtcccgaaatggaagatggacgccgccagcacggcggtggcatggccgtcgcgaatgccctccaccagatggtcgagattgcccacgccccccgaggcgatcaccggcacggtgacggcatcggccacggcacgggtcagcgggatgttgaagccctgcttggtaccgtcgcggtccatggaggtcagcagaatctcgcccgccccgtattcggtcatgcgccgcgcccattccaccgcatcgatgccggtggcattgcggccgccatgggtgaagatctcgaacttgccgggaccggtctgcttggcgtcgatggccaccacgatgcactggctgccgaacttctcggccgcctcgcgcacgaattcggggcgatgcacggcggcggtgttgatggagaccttgtcggccccggccagcagcagcttgcggatatcgtcgttgacccgcaccccgccgcccacggtcagcggcatgaagcactgctcggcggtgcggcgcaccacgtcatagatggtgtcgcggttttcgtgactggcggtgatgtcgaggaaggtcagttcgtcggccccggccttgtcgtagagcttggcctgctccaccggatcaccggcatcgatcaggtcgacgaagttgactcccttgaccacgcggccgtccttgacgtccaggcaggggatgatgcgcatcttgagcatggctcaggccttcaggagggcgatggcctgggccacgtcgatgcgcccgtcatagatggcgcggcccgagatgacgccttccagcttgggataagccttcagcgccttgagatcgaccagcgacgacacgccgcccgaagcgatcaccggaatggagatggcatcggccagcgcggcggtggccgccacgttgggaccggccagcacgccgtcacggtcgatatcggtgtagatcagggcggcgacgccgcaatcttcgaacttgcgcgccagctccagcacggtgaggtccgaggtctcggcccagccttccaccgccaccttgccgcccttggcgtcgatgcccaccgccacccgaccgggaaagcgctggcaggcctccttgaccagggccggattcttcaaggccacggtgccgaggatcacccggcggatgccccgcgccagccaatcctcgatggtggccatctcgcggatgccgccgcccaactggaccggaaccgaaacggatttgaggatgctgtccaccgcggcgccgttgaccggcttgccggcgaaggcgccgttgagatcgaccacgtgaatccactcggccccggcggcggcgaagtcgcgggcctgggcgccgggatcggtgttgaacaccgtggattcctccatcaggcccagcttgagccggacacaggcgccgtccttgaggtcgatggcggggaacagaaacattttagggagtccaggtcagaaagttggaaatcaccttgagccccgtgatctgggacttttcgggatggaattgggtgccgaccatgttgtcgcggcccaccacggcggtcacctggccgccgtattccacatgggcgagacgatgggcggggttggccggctcgaatttgtaggaatggacgaaataggcgtgggcctccgaatccagaccggccagcagcggatgggagaggccatcgggcaccagctggttccagcccatatgcgggaccttgaggccctggtcctcgacgcccaacggcaccacctcgcccgccacccagcccagaccggcatgcaggccgtgttcgcggccgatgctggccatcaactgcatgccgacgcagatgccgaagaacgggacgccccgcgccagcacccgctcggtcagggtctcggccatgcccggcagggccagaaggccagcgcgacaatcggcaaaggcgcccacgccgggcagcacgacgcgatcggcacggtccaccaccttgggatcattggtgacggcaacggaaagattcaggctggcctcggccaccacccgctcgaacgccttggcggccgagcgcagattgcccgagccgtaatcgatgatggcgacgatcccggtcacagaaccccccccgagcgacgcgaagcgacgctcatagcgatcctccaagggtgcccttggtcgaaggcaccgcgtcggccttgcgcgggtcgatctccaccgcctcgcgcagggcgcgggccagggccttgaagcagctttccacgatgtggtggtcgttgtcgccgtagaggctttccacgtgcagcgtcgcgccggcagcctgggcaaaggcctggaaccattccttgaacagctcggtgtccatggtgcccagcttgtcgcggccgaacgccaccttccaaatcaggtaaggacggttggacaggtccagcgccacccgggtcagggcctcgtccatggggacataggccgagccgtagcggcagatgcccttgcgatcgcccagggcctggttcaccgcctggccaatggcaatgcccacatcctcggtggtgtggtgggcgtcgatgtggaggtcgcccttggcgtccacctcgaggtccatcagcgagtgccgggacagctgctccagcatgtggtcgaggaaacccaccccggtgctcacggcatacttgccgctgccgtccagatcgacggcgaccttgatgctggtttcgttggtattgcgcgtgatggcagccttgcgcatggggccctccataatctgccccgtttagtatcaggaatgcgcgccctatgccagtgcgagccgccacaagcaatcggagcagccgtaaactataacttccgccgcggattgccgaataccctcttcgcctgtatggtgcatgcattcgttcttgtgatcggatgcggggggcatcaccatgaaatttggttcctgtttgaccgccgccatgatggcggcggcactgggcgcttgcgcacccaccacccagcggccggaagtcgatgccaagagccttcgaaccgaaaccaaccagcaatatgccttgctgctgcaaaatcatttggaacagcgcagtctgttcgacggcgttgttcaccgcctcagcgtggccgccagcgacttttgcgatgcccggatcaattggcggacgggatttctcaccttaagcaccgacgacgtcaatggcgccgccggcaagttgcttgcaacggcctatcctggcctcagttccacccccatggtgatcagtgtcacccggggctcggcggccgaacgggcgggactgaagaccggcgacctggtcacggccatgggcggattccccattccagccaccaagagtttccttgagtcaaccagcgcccggttcaatcgtgctaccaacgcgcctatcaccctcgccatccggcgcggcgaccagaccagcgacctggtcatcacgccggaacgggcctgcgactatcccagcaacatcatcgtcgacagttcaatgaacgcctttgccaccgagaaagacatcaacgtgcagaccggcatgttggacttcctaaagagcgaggaggaactggccctgatcatggggcatgaactggctcattccctgaggaagcacggcggaatgggcgccaagggaggcaacatggtggcgggccaggtggcgggcggcgtgctggacgtcatcgcggccctgggcggggtcaataccggcggatatttcagcaagtccggcggtgccatggcccgcaatatcaacagccaggactacgagaacgaggctgattatgtcgggctctacatcatggcccgcgccggatacaccatagacgacgccccgaaggtttggcgacggatggcggtgagcgaccccagcagcatttcccacgccacgacccacccgacggcgccggagcgcttcgtcaacctgaacgccaccattcaggaaattcgaaacaagcaggccgcgggcttgccgttgattcccaatgagcagcccaaagcggtggaaacccccaaagcacccgccgtgggcaacccctgaccccgggccgcgacaaaggcggcgagcgtctgctatgatgcccgccccttttccatttgggtcagcctcatgtccgagtcctctcttccttcctggcacggcacgaccatcctctgcctgcgcaaggacgggcgcgtggtcatcgccggcgacggccaggtcagcctgggcgccacggtgatcaagggcaatgcccgcaaggtgcgcaaggtgggcggcgggtccatcctggtgggctttgccggcgccaccgccgacgccttcaccttgctggagcgcctggaagccaagctggaaaagcatcccggccagctgacccgggcctgcgtcgagctggccaaggactggcgcaccgaccgctatctccgccgcctggaagccatgatggcggtggccgacaaggacgtctcgctggtcctcaccggccagggcgatgtgctggagcccgaggacggcatcatcggcatcggctcgggtggcaattacgccctggccgccgcccgcgccctgatcgacatcgacggcctggacgccgagaccatcgcccgcaaggccatggctatcgccgcgggcatctgcgtctacaccaacggcaacatgatcgtggaaagcctgtgatgagcgccgccgccttctccccccgcgaaatcgtttcggaactggaccggttcatcgtcggccagaatgacgccaagcgcgccgtggccatcgcgctcaggaaccgctggcgccgccagcagctttccgagtccctgcgcgaggaggttctgcccaagaatatcctgatgatcggccccaccggcgtgggcaagaccgagatcgccaggcgcctggcccgtctggcccaggcccccttcctcaaggtggaggccaccaagttcaccgaggtgggctatgtgggccgcgacgtggagcagatcgtccgcgatctggtcgaggtcgccatcctgatgacgcgggaacgcctgcgcaagcaggtcaccgccaaggccgagatcgccgccgaggaacgcctgctcgacgccctggtgggcgagaccgccggaaccgagacccgccagaagttccgcaagatgctgcgcgagggcgccctggatgccaaggaagtggaaattcaggtggccgagaccggcggcgccggcctgcccaccttcgacattcccggcatgcctggctcgcaggtgggcatgatcaatctcggcgacatgctgggcaaggccctgggcggcggccgcacccggccgcgcaagctgccggtgcccgaagccctggacgtcctgaccgccgaggaatccgacaagctgctcgaccaggacaaggtggtgaaggacgccatctgggcggtggaaaatcacggcatcgtcttcatcgacgagatcgacaagatctgcgcccgctcgtccgaacaccatgtgggcggcgatgtctcgcgcgaaggggtgcagcgcgacctgctgcccctgatcgagggcaccaccgtggccaccaaacacggttcggtgaagaccgaccacgtgctgttcatcgcctcgggagccttccatctggccaagccctcggatctgctgcccgaactgcagggacgcctgcccatccgggtcgagctgaaggcgctgtcccgcgacgatctggtgcgcatcctcaccgagcccgaggccagcctgctcaagcagtacgaggccctgctcgccaccgaggaggtcaccctcaccttcgagcccggctcggtggacgccatcgccgatctggccgccgagatcaacgccaccgtggagaatatcggagcacggcgcctgcagaccgtcatggagcggctgctggaggagatcagcttcaccgcgcccgaccagccacccggcaccaccgtcaccatcacggccgagatggtaagggagcgggtgggcgagctggccaagacggcggatctggccaagttcattttgtagccgcgattgggctgccgcccaagcccgcttggagggggcctccaaacctccctttctttttgaaaggaatggagggtttggggccgaggccccggtgcactatgattagaatcatagtctttggggggtgacatggaagactggggcaggattctcggtggcatccgcgccaccggccgcagcctggaagccggcgaggccctgttccgcgacggtgacgaggcccgcgccgtgtttcaggtggagcgggggcggatacgccttggccgccacggcgccaccctgcatcttgccaagaccggatcgctattggcagaaagcgccctgttcgcttcgcactacgcctgtgacgccgtggccgacaggcccagccgggtcaaggtgttccccaaggcggcggtcctgctttacctgcgcgcccatcccgacctcaacctggctttctcggcggccctggcccgcgaggtccaaagattgcgggccggtcaggagatcatgcgcctgcccggcgcgcgggaccgggtggtggcctggctgaccctgctgggcgccgccgagaccgccgtcaccctggaccagcccctctccgcaatcgccagtgagatcggcctgacccacgaggccctctaccgcaccctggccgccctggtgaaggacggccggctggagcgcccggaaaagagaagcttccgactgaaataaagggagggttcgggaggttcccctcccgatggggtgcggggcaaagccccgctaccggtcccccaacacctccagcaaccgcgccaccgtctcatcgggcagatcacggatggaccgccccaggcgattggccagctcggtatgggcgggggtgaggcccgaggtatccagcgtcaccttggggtgggacagctcggccagggatttcagctcctcggcctcgtcccagatacaccccagatagccgcagatctgcatgaccagaccgggggccggacggccgcgatggccgtgctccatggccgagagataggcggccgagatatggaggtccgtggccatctggcgcaactgaatgcccttggcctcgcgcagtgcgcggattcgcgccccgaagggagtcatgccgccctcgccgggcgcgaactccgttcgctgggccgcggcctcaatggccgctggagaccaaatccggcctgacggtccgtatttggtctcatgccctttgcctgcggatcaggacgtacagcgcgccgtcgccgccgtggcgaggctgggcgtaggaaaagcccaggatgcgttcccgcagcgggctttggttcagccagcgcggcacctgggcgcgcaggatgccgaagccctgggcgcccttgccggtgaccaccaggacgcagcggcgctgcgccacccagcagcgctggatgaaggcggtcagctgggcgtgggccatgtcctgggtcaggccgtgcaggtcgagatcggcctcgatttccatttcgccgcgcttcagccgctcggcggagcggcggtccaggccgggggagttgccgtggtgcaactcgccatggccggtgcggggcggcgtggggggatgggccgaggggcgcaccggcggcttgcccggcggcggcggcggcgaggccaccggttcgggcaaggcggcggcttcgggggagggatcggcgggaggcgaccggccgggcaggggcttggcctcggccaccaccgccttccagacccggatctcgtcggcggtgaccatccggcggcggggctggcgcggttcgaccagacgcgcccgggtcatcgcctcggactcctcatgatttcggcacgacctcgtcgtgcggcacgtcctcgtcggcgatggaggcccagcgatcccccggcttggggcttggcggagccatcacctcgggctcggcggtggccggcggctcgggctgcagggcgtcggccaggggcgcggtctccatgaccaccggggccggagtcggctcgggcggcggcggggagggagcggcggcgggctgggccggcggagcggtcatgcgcggaccggcgggaaccggggcgttggccatggcctgagcctgggactcgccctcgcccagattgcggcggatgaatttgcgccagtcgcccttgggtgcaaggcaaggcgcctcgttgacccccttgaccaccagggcgacgccgcccagctgccacagggtgacgaattgggcatagcccgccatgaggtaggcatgggcccgcatcttcaggcgccaggccacgtagtatttgttgccgtaaagatgggccagcacgcacagcgtcatggcgacgatgccggtggcgatgccgctggccagcagaatgatcagggccagggtggcctcgatggtcaggggcagcagatgatcccagtgctgatgcaccggcgagccctggaaatccagcaggcggggatcggtatagacctggacctgacccgcgcggatggcggcgcagagctgctcgtgcaactgctcctcctcgcgccccttgcgttccttccattccgccagcaatcggctcatcgccgcgatccgctccgtcttgaaaccactgtgccgtcgcgaaggatggacaagaggggcctggaaggcaacccctacctctcggccagccggggcgagcgcgccctgggcaggaaaagcaccaggcgcccggggctcttcatcttgccggcgacctggaaggcggcttcgcccgccccccagaacacgtcgccgcgcaccgggcccttgatggcggcaccggtatcctgggccaccatcaggcggcgcagcggccggcccgccgggtcgatgctgtccacccagacgggggcgcccagcggcacgaatcgcgggtcgacggccagggagcgttcaggcgtcagcgccacgccctcggtgcccagggggccttcgccaccggtgttgaagccatagaagatatagcggggattgcggcccagcagggtgcggccttcctcgggatgggccttgagccaggcgcggatggccggcatggaggtgtcggcgcccagcttaccctcgtccttcagcaccttgccgatgccgacgaatttgtggccgttgctgcccgccacgcccagccggatcaccgacccgtcgtccagccgcacccgtccggagccctgaatctgcatgatggccagatccaccggatcgtcggtccacaccagcacgggggccttgccgatcaggacgcccttgtcgatttcggcccgggtgtaatagggcaccagccgcccgttctccatccggccgatggcctgctcgcccgatccggtgaccaccagatcgttgggcttgccgaagatgggatggatgtaaggcgccttgcgctggcgcgagccccggatctccggctcgaaatagccggtgaacaagccgtcggcccggccgccattggtcacccgccagggcgtgaaccagctttcgaacaggatgcgggccgccatgtggtcgccgtcggccacccgctgggcggcagcgcagggggcataccagtcggcggcggtgccacccaccccctcgaagcccacggacttgtccagcggcagcttggtgatgcggttgcaggacttaagaagcgccggcagcacccgggccgattcgtcctcggaccagccggccagctggtcgaaggacaggggttgcagcaccatgcggtccggcccggcgggagcgggagccggcgccggttccggcgtggcgcaggcggccagcgacgcggccaccagggcagcggcggcgaaacgcctcatggctcgggcgtgtgggtggcggccagcgcccagttgggatcggcggagcgggtatcgcggcggaaggtccacaggtcgatcacgtcgatcacccgctcgggattgccttccaccacttcgcccttggcgtcgcgcagcgcgttgacctgctcgctgacgaagcggatggtcagcgcggcgaagcggccgtccatcccggcctccaccagttcggcagtgcggatgcccaccagctcggtctgcagcgtctcgccatgctggcgccgcgcatcgatggcgtcgctgaagtgacggtaaacatcgggagccagcagcggctgcaaggtcgccttgtcgccatgggcgaaggcgatgacgatcatctcgaacgccgccttggcaccgcccaggaagccgtccaggtcaaagccccggtcggcggcgcggatggcggccagcccctggcccatgggagtctcggccggcggctcggacgccgagcggcggacgctttgcagatccaccacgttatcggcggcggcctcgggcggggtccactgctcgggcggacgctcggcgccggtgcgcttgcccagcacgctgcgcaggcgcagcaccaggaaggcggcgaccattgcgaaaaaaacgatgtcgagaaaatgatagccgtcgttcatcaggccagtccaaggtaggctgcgtttccagtcaaagacataagacgggttgggggaaagagcaagcatggcatgggcattcctggttggcctgctgactttgccggtggccgaggtcctggtgtggatccgcgtggcggacgccatcggcggactggccaccgtgggtttgaccgtcctggccatcctggccggctcggccctgctgcgcggcggcggcctggggctggcgctcgacctcagggccaggctggaacggggcgagccgccgggacccatcgtctttgacggaatctgcatcgccttcgccggcttcctgctgatgctgcccggcttcatcagcgacgggctggcgctgctgctgctgctgccgccggtgcgggcgctgctgctccgcgccgtggtggtcagcccgggcccggcttcaccctccgatcccaccatcatcgagggcgaatacgagatcctttctcccgagcccgacccgaaccagcccccggatcacaagcggcttgagccgtgaaggtgtccgtgctacgccccttaccagccttttgatcgatgtcgtcccatccggagaacaccatgaccgacgcccagacgccgtccgaggacctgccccagctgcaggtcaacatgcagtacatcaaggacctgtccttcgagatccccggcgcgccccattccttcatcgagatgcagggcaagaatcccgagattccgatccatgtggacgtcaacgtgggcaatgtgggcgccaatgcctatgaagtggtgctccacctcaagatcgaggccctgctggacggcaaggcgctgttcatcctggaactggcctatgctggcgtgttcaccctgaacctgccggaagagcagatccacccggtgctgctcatcgagtgcccgcgcctgctgttccccttcgcccgcaatatcgtcgccgatatgacccgcgacggcggcctgccgccgctgctgctccagcctctggacttcgtcgagctctaccgtgcccgcgcggccgagatgaacgcccagcagggtcaggcgtaacaaacattattgggctattgcccaaacccatccggggccaatgccccggaccccatttttaatccatggggtttggggcccaaggccccaagcgggtgcgggcggcagcccgtcttattccctcagccacacggcgttcttgagcttggccacgaacgccgtgtgcgccgcggtttcctcctcggtcggtccgtggggccggggttcgcggaactcgcgggtcacctgatgggtcgaggcattggcggtgccgccggcaccattgcccttgccaccgcccaattccaggcccggctggcgcccgccgatcagctgcagatagacctcggccagcaattccgaatccagcaaggccccgtgcttggtgcggtgggtgttgtcgatctcaaagcggcggcacagcgcgtccagattggcctgggcgccgggaaagcgcttgcgcgccatcatcaccgtgtcgatggaccggctcatgggcaaggggggaaagcccagccgcgtcagctcggcgttgatgaagcgcatgtcgaattcggcgttgtggatgaccagcggcacatcgccgatgaattccaggaagtcggcgacgatctcggcgaacagcggcttgtccgacaggaaatccgccgacaggccgtgcaccttgaaggcctcttccggcatgtcgcgctcggggttgcagtagcgatgaaacaccgagccggtgggcaggtggttgaacagctcgacacagccgatttccaccagccgatgaccgctgaggggatcgaagccggtggtttccgtatcgagcacgatctcgcgcatggggactgcctttccaagaaaatattgggctctcgcccaaacccatctggggcttatgccccagacccccttttgattcatcaataaaagggaggtttggaggcatcgcctccaaccggggctgccgggcgggagccccgcatcatggcgaccaccgccttcagccgcttcaaggccgggcctttccccaggccggtgggaatcaccacgtcggccctgcggcgcttttgcccatcgggcatctgcttggccagcaccgcgtcaagccgctggcgcgtcatgcccggccgggccagcacccgggccgcctgaaggaaggcgggggcgctgaccaccgccaccaggtcgcagcgggattcgccgtgggtctcgaacagcagggggatgtcgagaaccaccagccgcgtccgagcgcgccgatggcgggcgaggaaatcgcgctcggcggcgcggaccagggggtggacgatggcttccagccgcttcagcgccgcgccgtcgccgaatacctgcgcacccagcgccgtgcggtccaccgctccgtccctgaccacgccggggaaggcggcatccaccgccgccaccgccttgccgccccgggcaaacagggcgtgcaccgtggcgtcggcgtcgtgcaccggcacgcccaggcgccgcagcatggcggccgccgtgcttttgcccatgccgatggagccggtcaggcccaggatcttcatgacaggacgaaggcccgcaattggtcgctgacctggggccgttgcccgaaccaggcctcaaagccgggcaccgcctgatgcagcagcatgcccagcccgtcgacaatgggattcccccgggcggtcgcgcgggccagcagatcggtgaccagcggcacatagacgatgtcattaaccacggacgtggttggcagggccgcaaggtccagatccaaactcgactgaccggtcatccccagggtggtggtattgaccagcagggcgcagccttccaggctttccgcccgttcggcccagtccaccaccgtgacgggaccgccgagatcggcggccagggtcgcggcgcgctcgcggctgcgattggccagacggatctccggcactccggcatcggccagcgccgccaccacggcgcgggcggcgcccccggcgccgatcaccgccgccgggccggaggtcggctcccagaggggacagccctggcgcagattttcgaaaaaaccataggcgtcggtgttacggccttccaaggtgccgtcctggcggaccaccagggtgttgaccgccccgatacgccgggccaggggatcgaggtgatccaccagccgcatcaccgcctccttgtggggcacggtgacattagccccggcaaagcccatgcggggcagggcgcggatcacggtctccagatgctcgggggccacggccaggggcagataggcgccgtcgatgcccatttgctccagccagaagccgtgcaggcggggcgagcgggaatgggaaactggccagccgagcaccccggccagtctggccttaccggacacgatcatgggaccagctctccgttctcgcgcagaaaatccatcagggccagcaggggcaggccgaggatggtgaagaaatcgccctcgacgctcaggaacagctgggaacccaggccctccagctggtaggcacccaccgaggtctgcaccgcctcgcccgcctgatcgagatagccatctaggaagttttccgagaagttgcgcatggtcagcttggcggcttcggtgtggtgccacacccgccgcccgtccctgaccgccaccaccgccgaggtcaggcggtgagtcttgtggcgcagcgccagcaattgggcccgcgccccctgccggtcggcgggcttgtcgaaccagacattgtcgcaatcgagcatctggtcggcgccgatcaccagggcgccgggatggcgcgccgagacgcgcaccgccttcagctcggccaggatctcggcgacccgggcgggattacgggtctcggccgccatggagtgcttgaccgcctcctcgtcgaccgccgccacgtcgacggtgaaggcaattcccgcctgttccagcatgcgggccctggcggtgctgcccgaggcgagcacgatcatgagggcaggacctccgccttgagcccgcgcttttccagatggcgctcatagagctggatgatagtggccgaagcctcctcgatggagcggcgcgtcacgtccaccaccggccagcccaggcgcgagaagatgcgccgcgcctgctggacctcctccttgaccttctcgaactgggcgtaatcggcttcctcttcctggttcagcaggcgcagccgggcgcggcggatatcggacaggcttttggggtctttggtcagtcccaccaccagcggctttttcgcccgttccagctcgggcggcagcggcacgccgggcaccaggggataattggcgcatttgaagccgcgattggccagatacatgcaggtcggcgttttggacgagcgcgacactcccaccagcacgatatcggcctgatcggccaactcgatcaactggccatcatcgtgggacagggtgaattgcatggcatcgatacggcggaagtactcggcgtccaactgatactggcggccgggcagggcggtaacctcgacgcccaggaaggccgacaatccagccatcaccggatcaagcagcgagatgcagggaatgccgcgatggcggcacgcttcctccagcaggccgcgcaccgcgccgtccaccagggtgaaaaacaccagcccgggattgtcctcgatgccggcgatgacccgctccacctgaccctgggtgcggaccagccaccagttatgctggatgggctgcacgccctcgaactggacgaggcaggccctggccaccgaggtgaccgtctcgccggtggcatcggagacgaggtggaggtgaaaattcttcatgcctgtggataacccgcaagaccgtggataaggaggggtcccggcggggggtgggaaattcgctccccactggccccgattccatggaggcacatccccccatgtccaaaacctttccgctgtcctcgacaatagcgtgaatcgtcgccggcgacatccgatttccccattttccccagggggcgaaggcgtgagaaaacaacggtctggcccggttgacccccactcatccacaaggaggagaggggcggccgaaagttgggacaagcctgtggatggcttcggcaaaatgtccaatccccgttatccacaggcacccactaaccacagcaaccttttctctaaaccttaaagtctgtaagacagagccatctccagcccgcgaggttcccccgtgtccagctcgtccaagcccttcctccgcgcccttgccggcgagacccttacgcctccgcccttctggctgatgcgacaggccggacgctatttgccggaataccgggccacccgggccgaagccggcagcttcctggatctttgctacaattccgacctggcctgcgaagtcaccctgcagcccttgcggcgctatggcttcgacgcggccattctgttctccgacattctcgtggttcccgacgcgttgcggcagcatgtcgcgttcaaggaaggcgaaggtccggtattgacgccgattcgctcggcagaggatctgagtggtctcgacctctcgggcctgcacgaccatctcgcgccggtttacgaaacggtcaagaagctgtccgccgccattcccaagaccaccgccctgatcggtttcgccggtgcaccctggaccgtggccacctatatgatcgagggcagcggctccaaggatttcgccaaggccaagggcatgatgttcggccagccggagctgttcgcccgcctgatggcgctgctggtccaggccaccggcgattatctgatccgccagatcgacaacggcgccgaagccatccagattttcgacacctgggccggagccctgcccgaggacatgttcgagcgctgggtgatcggcacgacccgtaccctggtggagcgcatccgcaccgagcggccgggcgtgccggtgatcgggttcccgcgcggggccggatatctctacaagcgctatgtggccgagaccaaggtcagcggcgtctcgctcgacccctcggtgccgctgcactgggcggcggccgagttgcagcccaagtgcaccgtccagggcaatctcgatccgctgttgctggtggctggcggcgaggcgctggatgccggtatcgaccgggtgctgaaggcgctgtccaaaggacccttcatcttcaatctgggccacggcatcaccccgccgactccgccggacaacgtggcgcggctggccgagcgggtcaaaggctggaaaggctgagaccatgagcgaagcgaagccgaagcgcgggagccaagggtgcggaggcacccgcccggcgcttgaggggcaaaggaaatgagcgaggcggggggcaggaagacggccgtcgtgctgttcaatctcggtggacccgattcgctggatgcggtcaaaccgttcctgttcaacctgttcaacgacccggccatcatcggcgcacccgctctcattcgctggctgctggcgaagtatatttcggccaagcgggcgccgacggcccgcggcatctaccagatgctgggcgggcgctcgcctttggtgcccgagaccgaagcgcagggccgcgccctggaacatgtgctgggacatggtttccgctgtttcatcgccatgcgctattggcatcccttcacctacgagacggttgccgccatcagggaatggggcgccgacgaagtggtgctgctgccgctgtatccccagttctcgaccaccaccacgggctcatcgctgaaggagtggcacaagcaggcggaacggcagggtcttgtcgtccccacgcgcatggcctgctgctatcccaccgagccgggtctggtggacgccatggccgatctggcgaaagcgggccatcaggaggccgccgccgccggcaagccccgcattctcttttcggcccacggcttgccgaaatcggtgatcgccaagggtgatccctatcaggcccaggtggaattgaccgcggcggccgtggccagcgccacgggaatcgccgatctcgactgggccatctgctatcaaagccgggtgggtcccatggaatggatcggtcccagcacggaagccgaactggaacgcgccgcccgggatggggtcccggtggtgatcgttccagtcgccttcgtctccgagcattccgagaccctggtggaactggatatcgagtatcgccacaaggccgaccagctgggcattcccgcttatgtgcgggtgccggccctgggctgccaccccgccttcatccggggattggccgaggtgattcaccggccgcaagcctttaccggccaggcctgcaagcgtctgggacgggtttgcccatcatgctgagtggaacggcctatctgtgggtcaaggcggtgcatgtcatcgccatcatctcgtggatggccgggttgctttatctgccccggctgttcgtctaccacaccacggtcaagccgcgctccgagacctcggagaccttcaagatcatggaacgccgcctgatcaaggcgatcatgacccccgccatggtcctggcctggattctcggtctggtcatggcggtggacggcggcctgttctcccagggctggtttcatctcaagctggcctgcgtggtcgccatgaccatcgcccattttttcctcgcccgctgcaaggatggctttgccgaggaccgcaacacccggtccgagaagttctatcgcgtcatcaacgaggtgccgaccttgctgatgatcgtcatcgtcatcgtggtgatcgtgaagcccttctgaaaggttttgacagcaccgccagctttggctaatgctctagcgaaattcccagggcggacaatacgcccgtttcccaccatcccccttccgcgccggatcattcgtatccgttcctgatcggcagcaggtccgcaacagttcggacccgtcccaccttaagtccgatcgattgcgcggaacatccatccaacggatctctctcatgcatttgcaggacctgaagaagaagaccccggccgaactcctggcctttgccgaagagctggaggtggaaaacgccagcacgcttcgcaagcaggacatgatgttcgccatcctgaagcagctggccgacaacgatacgcccatctacggcgacggcgtgctggagatcctgcaggacgggttcggcttcctgcgcagccccgaggctaattatcttcccggtcccgacgacatctatgtcagccccagccaggtgcggcgcttcggcctgcgcaccggcgacacggtggacggtcagattcgggcgcccaaggacggcgagcgctatttcgccctgctgaaggtcaacaacatcaatttcgaggacccggaaaaggtccgccaccgcatcaacttcgacaacctgacgccgctctatcccgacgagaagctgaagctggagatcgaggaccccacccgcaaggatctcaccacccgggtgatcgatctggtggctcccatcggcaagggccagcgcgccctgatcgtcgcgccgccgcgcaccggcaagaccgtgatgctgcagaacatggcccatgccatttcgctcaatcaccccgaggtctacctgatcgtgctgctgatcgacgagcggcccgaggaagtcaccgacatggcccgttcggtgaagggtgaagtcatcagctccaccttcgacgagccggcgtcccgtcacgtccaggtcaccgagatggtgctggagaaggccaagcgtctggtcgagcacaagcgcgacgtggtcatcctgctggattccatcacccgcctggcccgcgcctacaacaccgtggtacccagctcgggcaaggtgctgaccggcggcgtcgacgccaacgccctgcagcgccccaagcgcttcttcggcgcggcgcgcaacatcgaagagggcggctcgctgtccatcatcgccaccgcgctgatcgataccggttcgcgcatggacgaagtgatcttcgaagagttcaagggcaccggtaactcggaaatcatcctggaccgcaagctgtcggacaagcgcaccttcccggccatcgacatcaccaagtcgggcacccgcaaggaagagctgctggtcgacaagggcatcctgtccaagatgtgggtgctgcgccgcatcctcatgcccatgggcgtggtcgacgccatggaattcctggtggacaagctcaagcactcgaagaacaacggcgatttcttcgaagcgatgaattcctaggcgatatcaatgcgaagggacttgtcccttcgcgcatccctctttcctatttggaatcaaaagggggcccggggcattggccccgggcggggtttggggccgtggccccaatcattcctcagttatgccccgacgtccggcgccggtgatggcggcgatggctttggctcagcaggtcatcagaggggctgtcgtcctcggaacggcgccgccatagatggacgccgccggccagcagcatggggggcaccaccacgatggcgatgcggcccagcatgttgaagaaggaattgcggtcggtgtcgatgaccacctggttcttgcactcgtagcgctgcttgaaggtgcccgagcaatcgcgcagccgttccttgacggcgtccgaggaatggttttccaccgtcccttccggaaggttggcgaactggctccagcccgcccaagccatccagaccagactgaccgtcgtcaccatcacattgccgatcttggacacgccatcctccgacccgggtccgttgccacatcccggagtccaatattctttcggatggggcgttacggcaagaggagagtggagccggtggtcttgcgtccctccaggtcacgatgggcctggggggcgtccttcagggcataggtctggttgattccgatattcaccacgcctttttccaccacatcgaacaattcgccggccgaggccagcatgtcggagcgcttggcggtataggccatcaggctcggccgggtcaggaacagcgagcccttggcggccagcaatccggtatccaggggctcgaccttgcccgagctttggccgaacgacaccatcatgcccagcggccgcaggcaatccagcgacttcaggaaggtgtccttgcccacggaatcgtagaccaccggcacgccttcgccgttggtgatctcgcgtacctttgccacgaaatcctcggacttgtagagaataggatggtcgcagccatgggccttggccaattccgccttttccggcgatcccaccgtgccgatcaccgtggctcccagatgcctggcccactggcagaccagcagacccaccccgccggcggcggcatggatcaggatggtgtcgcccgcctggacgcgataggtccggcgcagcaggtattgggcggtcatgccctgcagcatcatggcggcggcggtgcgctcgtcgatggcgtcgggaagcttcaccagccggtcggcgggcatcagccggacctcggcataggctcccagcggcggattggcataggcgacgcgatcgccgaccttcaaatccgtgacgtcgtcacccaccgcttcgaccacgccggcgccttccaggccgggggtgaagggcaggggggcagggtaaagcccgctccggtgatagacgtcgatgtaattgaggcccacggcggtatggcgcagcagcacctgaccggccgcggggacggcaagatcgacctcttcccagaccatgacctcggggccaccgggctggtgaatgcggatggcgttggtcttcacttgagggggactccttcatgacgcagcaggaattccttggtctccacgccatcgatgccggaatagccgcccatggcgccattggcgcccagcacgcggtggcagggaatgatcaccggaataggattgcgaccgcaggcgccgcccagcgcacggggcgcggtacccaattcctcggccagttcgccatagctccgggtctggccgaagggaatccgcgacagggccgcccacaccttctgctggaaggcggtgccgtgcggcgccagcggcaagtcgaagctggtgcgcttgccgtcgaaatactcctccagctggtcgcgggccttgagcagcaggggagtctcgtcgttctcgggcaggaagccccaatccaccgcgacgatggcgccatcggcttcgaacagggccagcggcccgatgggggaattgaaggcgagttgcggcatggtggcggttacttcttgctgagcagggcggccaattggtcgggatcggtgaccggcgcccggcaggtggagccctggcaaatataggccgcggcccggccgtcgaccagagacttgccgtgggccggatggcctgggggcagggcggcgccgttgtccacccgcagcagcgagaccggcggcaggggtgtggtggcgaaagtgcgcagcagggcacggccgcctgaatcatccagcggtccgacgatcaccacttgcagcggctcggccaggatagcgaaggcctccagcagggacgtcatgtggggaatctgctcggggatggcagcgccgaaggcatcgatcaccgcctgagaccgctcgcgccaggcctcgtcgccggtgaccagccacagccgggccagggcctcggccatcatgccgttgccgctgggcaccgccgagtcgaaggccggcttggtgcggatcaccacgtcgccggcgtcgtcggccgaaaggaagtagccgccttccgctccatcccaatgatgggcgtgaacctggtccgcccagacaagagcacgctccaggtattccggcgcggcggtggcttcatgcaggctaagcgccgccaggatcaaccaggcgtaatcgtcgagcacggcggcggtttcggcccggccctggcacagggaatgggcggggcggccatcgggacgggtcatgcgggtggtgatgacttcgaaagccttccgcgcggcggtcagccagtccgggcgatcgaaggccagggaggcctcggccagggccgagatggccatggcgttccagtcggccaggaccttatcgtcgcgtcccggccagatgcgcttgtcccgcgccgccagcagcaccgccttggcttcggcgaggtcgccatcatcaccgccgcctcggggatggttgcggtggaggatggtgcgcccctcccaattgccatgggcccgcacgtcgtaaagggtgccgaagcggatggcggtgtccatgtccatcagggcggagagttcctccgacgtccaggtatagaacagcccttcctcgccctcgctgtcggcatccagcgcggcggcgaaggcgtcgccctcggccatcatgtcgcgcagcagccagcccaccgtttcgaagatgcgggtgcggtagagcggcgagccggtgtgcttccacaccttggtcagcagcgacagcagctgggcattgtcgtagagcatcttctcgaaatggggcaccagccagaactcgtcggtggagtagcgcatgaagccgccgcccagatggtcataaatgccaccctggcaaatgtggttcagcgtcacggtaacggcatccttaaggctggaattgccggttctcagataggaatgccacaggaaacggaacaggccgggctgggggaatttcggcgcgcccacggtgccgccgtcctcgaaatcgatcaggcgcaggcattgggcggcgcccagatccaccacttccatatccaatgccaaggggccgggcgagcgggccatcttttccaggctctcgcggatgcgctccacattgtggctgatcttctccgggtcgcgatggaagctgtgggcgatgccctccagcacgtcggggaaggcggcgcggccatagcgggtggtggcgggaaagtaggtgccgccccagaacggctcggcgtcgggggtcaggaacatggtcagcggccagccgccgtgctggcccatcaggcccagggcgttctggtagagggcatccaggtccgggcgttcctcgcgatcgaccttgatgttgacgaacagacggttcatcagcccggcgatgccagcgtcctcgaagctttcatgggccatgacgtggcaccagtggcaggcggaatagcccaccgacagcaggatcggcttgttgctggccttggcctcggccagggcctccggcccccaggcccaccaatggacgggattgtgggcatgctgcagcagataggggctggtctcggcggccagtcgattgtgagacattcatcgatccttgaaacggcaggacattgcgccgggggaggctaatgcttagtttgggtgaaagtgggccgagcgcaagacgaggacgacatgaagattaccgtggacgtggattgtaccccagaggaggcccggacctttctcgggctgcccgacgtcaagcccatgcaggaagccctgctgaagcagatccaggatcagatggccgccaatctgcacgccatggaaccggagaccatgctgaaggtctggctgcccgccggggtccagggcatggagcagctgcagaagatgttctggtcccagttctcctccggctcgcgccccaaggagagcaagccgtgagccgcctgcccggcgatccacccgattatttccgggtccatgtcttcatctgcaccaatcgccgtcccgacgacaacaagcgcggctcgtgcgccgggcggggttccgaggcgctgcgcgaacacatgaaggacgcccagaagaagctcggcctcaaggatgtacggatcaactccgccggctgcctcgaccgctgcggcaaggggccggtgatggtgatctatcccgagggcatctggtacagcttcaatagcgtggccgacctggatgaaattctcgagacgcatatcgtcgggggcggccgggtcgagcgtctgatgctcgcgcccaattcctga

SEQ ID NO: 3 - DNA, 2975 bp, Magnetospirillum magneticum
gaattcgggtggaaagctcgccgtcggccagggcggtcatggcgccggtcatggccttgaccggggcgaccatgccgaagatgacgccggcgaccccggccagggtgacggccagcaccacccccgataccgaccacaggatcagcatgaaggtctgctcgcgctgggcggcataggcctcggtatcggtggtcagcttgtcggcgcccttgaccacctcatcgatttcggcccggtgcgcggcataggcggccgagatctcggcgaaggcggcgcgggcggcatccatctcgcccctttccagggcgggcaggaagccctgatcgatcaccgcccacaagcgcatggccggggcatgggcccccaccaccaggcggtcgcgcaagccggcctccatgtcctgggccagccaataggcgtggcgctcgtcatactccttgcgcagcttggccagggccgccttgcgctcgggcaggctgtcggggttggccagggccagattggtctccagataggcctcgatgacgtattccggcggcggcaggatgtcggccaccagatccttgccctggacgatccgctggtagaccggtccgcccaccttcaattcgccgatggccaggtacccggcggccatgatcgccaggaacccggccaccagggagacggcaaacagattggtcagtcgtgcgatggtcaggccgctgtgcatggaaacccccaattgaacgcgccagtctcgaataagcgcctacgcgattctacttgtgcacagaatatgagcaatacctgctttcggcataatttttatgcagccgtcgtcacatttccgccacatcggggctttagaccgggggctgccttcgtgataagaacgcgtccatggaactgcatcatcccgaactgacctatgccgccatcgtcgccctggccgccgtgctgtgcggcgggatgatgacgcgcctgaagcagccggccgtcgtcggctacatcctggcgggggtggtgctgggacccagcggcttcgggctggtgagcaaccgcgacgccgtggccaccctggccgagttcggcgtgctgatgctgctgttcgtcatcggcatgaagctggacatcatccgctttctcgaagtgtggaagacggccatcttcaccacggttctgcagatcgccggcagcgtgggcacggccctgctgctgcgtcacggcctgggctggagcctggggctggcggtggtgctgggctgtgccgtggcggtgtcgtccaccgccgtagtgatcaaggtgctggaatcctcggacgagctggacacgccggtcggccgcaccacccttggcatcctgatcgcccaggacatggcggtggtgcccatgatgctggtgctggaatccttcgagaccaaggcgctgctgcccgccgacatggcccgggtggtgctgtcggtgctgttcctggtgctgctgttctggtggctgtccaagcgccgcatcgacctgccgatcaccgcccggctttcccgcgattctgaccttgccaccctgtcgaccctggcctggtgtttcggcaccgccgccatctccggcgtgctggacttgtcgccggcctatggcgccttcctgggcggcgtggtgctgggcaattccgcccagcgcgacatgctgttgaagcgtgcccagcccatcggcagcgtgctgctgatggtgttcttcctgtccatcgggctgctgctcgacttcaagttcatctggaagaatctgggcaccgttctcaccctgctggccatggtgaccctgttcaagacggcgctgaacgtcacggcgctgcgcctggcgcggcaggactggcccagcgccttcctggccggcgtggccctggcccagatcggcgagttctcgttcctgctggccgagaccggcaaggcggtcaagctgatcagcgcccaggagaccaagctggtggtggcggtcaccgtgctgtccctggtgctgtcgccgttctggctgttcaccatgcggcgcatgcaccgggtggcggcggtgcatgtccattcgttccgcgatctggtcacgcggctgtatggcgacgaggcccgcgctttcgcccgcaccgcgcggcgggcccgtgtgctggtgcggcgtggttcctggagggatgaccccaatgccggacctggctctggaatttgagatcggcggcatcgtctgcggcatcgacgaggtgggccgcggccccctggccgggccggtggtggccgccgcggtgatcctcgaccccgcccgcctgcccaagacgctgctggagcggctggacgattccaagaagctatccaagcgtaaccgcgaagaactggccgaactggtgcccgccaccgccatccttggcttcggcgaggcttcggtggaggagatcgaccggatcaacatcctgcaggcgacgtttctcgccatgcgccgcgcctatgacgccctggggcgggaatgcgcccatgcgctggtcgacggcaaccggccgccggggctgccctgcccggtccgctgcgtggtggggggcgacggcatctcattgtccatcgccgccgcctcggtggtggccaaggtgcggcgcgacgccatgatggccgatctggcccgcgcccaccccgaattcggctgggagaggaacgccggatacggtacggccgagcatctggacgccctgaaacgcctcggtcccaccccccatcaccgacgctccttcgcccccgtggcccaatatatgctgttctaacctgtggataagccactacctgtggcaatgaatcattagattccaacaggttcttgacggactctcatgtttgactcaaattgagtgctccaactcatttgaatcggtccgccatgaccctgcctctcaacaccattctctccggcgactgcatcgccatgatgaactccctgcccgccggttcggtggatctgatcttcgcggatcc

SEQ ID NO: 4 - DNA, 1315 bp, Magnetospirillum magneticum
gtccatggaactgcatcatcccgaactgacctatgccgccatcgtcgccctggccgccgtgctgtgcggcgggatgatgacgcgcctgaagcagccggccgtcgtcggctacatcctggcgggggtggtgctgggacccagcggcttcgggctggtgagcaaccgcgacgccgtggccaccctggccgagttcggcgtgctgatgctgctgttcgtcatcggcatgaagctggacatcatccgttttctcgaagtgtggaagacggccatcttcaccacggttctgcagatcgccggcagcgtgggcacggccctgctgctgcgtcacggcctgggctggagcctggggctggcggtggtgctgggctgtgccgtggcggtgtcgtccaccgccgtagtgatcaaggtgctggaatcctcggacgagctggacacgccggtcggccgcaccacccttggcatcctgatcgcccaggacatggcggtggtgcccatggtgctggtgctggaatccttcgggaccaaggcgcttcttcccgccgacatggcccgggtggtgctttcggtggtgttcccggggctgctgttctggtggctgtccaagcgccgcatcgacctgccgatcaccgcccggctttcccgcgattctgaccttgccaccctgtcgaccctggcctggtgtttcggcaccgccgccatctccggcgtgctggacttgtcgccggcctatggcgccttcctgggcggcgtggtgctgggcaattccgcccagcgcgacatgctgttgaagcgtgcccagcccatcggcagcgtgctgctgatggtgttcttcctgtccatcgggctgctgctcgacttcaagttcatctggaagaatctgggcaccgttctcaccctgctggccatggtgaccctgttcaagacggcgctgaacgtcacggcgctgcgcctggcggggcaggactggcccagcgccttcctggccggcgtggccctggcccagatcggcgagttctcgttcctgctggccgagaccgacaaggcggtcaagctgatcagcgcccaggagaccaagctggtggtggcggtcaccgtgctgtccctgggtctgtcgccgttctggctgttcaccatgcggcgcatgcaccgggtggcggcggtgcatgtccattcgttccgcgatctggtcacgcggctgtatggcgacgaggcccgcgctttcgcccgcaacgcgcggcgggcccgtgtgctggtgcggcgtggttcctggagggatgaccccaatgccggacctggctctggaattagtacttag

SEQ ID NO: 5 - DNA, 1324 bp, Magnetospirillum magneticum
taaagtactgtccatggaactgcatcatcccgaactgacctatgccgccatcgtcgccctggccgccgtgctgtgtggcgggctgatgacgcgcttaaagcagccggccatcgtcggctacattctggcgggcgtggtgctggggcccagcggcttcgggctggtgagcaaccgcgatgccgtggccaccctgggcgagttcggcgtgctgatgctgctgttcgtcatcggcatgaagctggacatcatccgctttctcgaagtgtggaagacggcggtcttcaccacccttttgcagatcgccggcagcgtgggcacggccctgctgctgcgtcacggcctgggctggagcctggggctggcggtggtgctgggctgtgccgtggcggtgtcctccaccgccgtggtgatcaaggtgctggaatcctcgggcgagctggagactccggtcggccgcaccacgctgggcatcctgatcgcccaggacatggcggtggtgcccatgatgctggtgctggaatccttcgagaccaaggcgctgctgcccgccgacatggcccgcgtggtactgtcggtgctgttcctggtgctgctgttctggtggttgtccaaacgccgcatcgacctgccggtcaccgcccggctgtcgcgcgattccgaccttgccaccctgtcgactctggcctggtgtttcggcaccgccgctatctccggcgtgctggacctgtcgcctgcctatggcgcctttctgggcggcgtggtgctgggcaattccgcccagcgtgacatgttgctgaaacgggcccagcccatcggcagcgtgctgctgatggtcttcttcctgtccatcgggctgctgctcgacttcaagttcatctggaagaacctgggcaccgttctcaccctgctggccatggtgactctgttcaagactgcgttcaacgtcacggcgttgcgcctggcgggccaggactggcccagcgccttcctggccggcgtggccctggcccagatcggcgcgttcccgttccttctggccaaaaccggcaaagcggttgggcgtataaccgcccagaaaaccaaactggtggtgggggtcaccgttctgtccctggttctgccgccgttctggctgttcacaatgcggcggattcaccgggtggcggcggttcatgtccattcgttccgcgatctggtcacgcggctgtacggcgacgaggcccgcgccctggtccgcaccgcccggcgggcccgcatgctggcgcggcgcggctcatggagggatgatcccaatgccggacctggctctggaattagtacttag

SEQ ID NO: 6 - DNA, 1312 bp, Magnetospirillum magnetotacticum
  misc_feature (13)..(13): n is a, c, g, or t
taaagtactgtcnatggaactgcatcatcccgaactgacctatgccgccatcgtcgccctggccgccgttctgtgcggcgggctgatgacgcgcctcaagcaaccggccatcgtcggctatatcctggccggggtggtgctgggccccagcggcttcgggctggtgagcaaccgcgacgccgtggccaccctgggcgagttcggcgtgctgatgctgctcttcgtcatcggcatgaagctggacatcatccgttttctcgaagtgtggaagacggcggtcttcaccaccgttttgcagatcgcgggctccatcggcacggcgctgctgctgcgccacggtttgggctggagcctggggctggcggtggtgctgggctgcgccgtggcggtgtcgtccaccgccgtggtgatcaaggtgctggaatcctcgggcgagttggaaacgccggtggggcgcaccacgctgggcatcctgattgcccaggacatggcggtggtccccatgatgctggtgctggaatccttcgagaccaaggtgttgctgcccgccgatctggcccgcgtgatcctgtccgtgctgttcctggtgctgctgttctggtggctgtccaagcgccgtatcgacctgccgctgacctcgcggctgtcgcgggattccgatctggccaccctttcctccctggcctggtgctttggcacggcggccatttccggggtgctggacctgtcggccgcctatggcgcctttctgggcggcgtggtgctgggcaattccgcccagcgcgacatgctcttgaagcgcgcccagcccatcggcagcgtgctgttgatggtgttcttcctgtccatcgggttgctgcttgatttcaagttcatctggaagaatctgggcaccgttctcactcttttagccatggtgacggtgttcaagacggcgctgaacgtcgccgcgctgcgtctggcgcgtcaggacttggccagcgctttcctggccggggtggccctggcccagatcggcgagttctcgtttttgctggccgagaccggcaaggcggttaaactgatcaacgccaaggagaccaatctggtggttgcggtcaccgtgctgtccctggtgttgtcgcccttctggctgttcaccatgcggcgcatgcatcgggtggcggcggtgcatgtccattcgttccgcgaattggtctcgcggctttacggcgacgaagcccgcaacgcgcggcgggcccgcaccctggtgcggcggggctcttggagggatgatcacaatgccggacctggctctggaattagtacttag

SEQ ID NO: 7 - DNA, 1756 bp, Magnetospirillum magnetotacticum
  misc_feature (802)..(802): n is a, c, g, or t
ccgcggccgagtcctcttcctccctggcgcgcgcagcgcgcagacgggcgtcgaggtcatcgaaagacgggggcgtctcgtggtcagccataggtcagtcctcgaaatcccccttctggcgctttggtgccaaaagcgcgggcaccataaggtctggacccacccgtgtcaaggactcaaaccggcgaagccaacacgctgaattgcattggtgaatcagggggtttgcggggtcgcgccatgccggatgctgcgttgcggcaagattcttcccacccaagggggtggcgtcaggtgggattcggccaccgatcgcttatccccatttccgtcccgatgattttccgcccccctccagccgcctcactcttgcaacatccgcactttagaccgtgggctgccttcgtgttaagaacgtgccatggacctgcatcatcccgaactgacctatgccgccatcgtcgccctggccgccgttctgtgcggcgggctgatgacgcgcctcaagcaaccggccatcgtcggctatatcctggccggggtggtgctgggccccagcggcttcgggctggtgagcaaccgcgacgccgtggccaccctggccgagttcggcgtgctgatgctgctgttcgtcatcggcatgaagctggacatcatccgttttctcgaagtgtggaagacggcggtcttcaccaccgtttcgcagatcgcgggctccatcggcacggcgctgctgctgcgccacggtttgggctggaacctggggctggcggtggtgctgggctgcgccgtggcggtgtcntccaccgccgtggtgatcaaggtgctggaatcctcgggcgagttggaaacgccggtggggcgcaccacgctgggcatcctgattgcccaggacatggcggtggtccccatgatgctggtgctggaatccttcgagaccaaggtgttgctgcccgccgatctggcccgcgtgatcctgtccgtgctgttcctggtgctgctgttctggtggctgtccaagcgccgtatcgacctgccgctgacctcccggctgtcgcgggattccgatctggccaccctttcctccctggcctggtgctttggcacggcggccatttccggggtgctggacctgtcgcccgcctatggcgcctttctgggcggcgtggtgctgggcaattccgcccagcgcgacatgctcttgaagcgcgcccagcccatcggcagcgtgctgttgatggtgttcttcctgtccatcgggttgctgcttgatttcaagttcatctggaagaatctgggcaccgttctcactcttttagccatggtgacgctgttcaagacggcgctgaacgtcgccgcgctgcgtctggcgcgtcaggactggcccagcgctttcctggccggggtggccctggcccagatcggcgagttctcgtttttgctggccgataccggcaaggcggttaagctgatcagcgcccaggagaccaagctggtggtggcggtcaccgtgctgtccctggtgttgtcgcccttctggctgttcaccatgcggcgtatgcatcgggtggcggcggtgcatgtccatccgttccgcgaattggtctcgcggctttacggcgacgaagcccgcaccgcgcggcgggcccgcaccctggtgcggcggggctcttggagggatgatcacaatgccggacctggcactggaatctgagatcgggggcatcgtctgcggcatcgacgaggtgggccgcgg

SEQ ID NO: 8 - DNA, 640 bp, Magnetospirillum magneticum
ctaagtactaattccagagccaggtccgsgcgtgctggacttgtcgccggcctatggcgccttcctgggcggcgtggtgctgggcaattccgcccagcgcgacatgctgttgaagcgtgcccagcccatcggcagcgtgctgctgatggtgttcttcctgtccatcgggctgctgctcgacttcaagttcatctggaagaatctgggcaccgttctcaccctgctggccatggtgaccctgttcaagacggcgctgaacgtcacggcgctgcgcctggcgcggcaggactggcccagcgccttcctggccggcgtggccctggcccagaycggcgagttctcgttcctgctggccgagaccggcaaggcggtcaagctgatcagcgcccaggagaccaagctggtggtggcggtcaccgtgctgtccctggtgctgtcgccgttctggctgttcaccatgcggcgcatgcaccgggtggcgscggtgcatgtccattcgttccgcgatctggtcacgcggctgtatggcgacgaggcccgcgctttcgcccgcaacgcgcggcgggcccgtgtgctggtgcggcgtggttcctggagggatgaccccaatgccggacctggctctggaattagtacttag

SEQ ID NO: 9 - DNA, 560 bp, Magnetospirillum magneticum
taaagtactgtccatggaactgcatcatcccgaactgacctatgccgccatcgtcggcctggccgccgtgctgtgcggcgggatgatgacgcgcctgaagcagccgsccgtcgtcggctacatcctggcgggggtggtgctgggacccagcggcttcgggctggtgagcamccgcgacgccgtggccaccctgggcgagttcggcgtgctgatkcttctkttcgacatcggmatgaagctggacatcatccgctttctcgaagtgtggaagacggccatcttcaccacggttctgcagatcgccggcagcgtgggcacggccctgctgctgcgtcacggcctgggctggagcctggggctggcggtggtgctgggctgtgccgtggcggtgtcgtccaccgccgtagtgatcaaggtgctggaatcctccgacgagctggacacgccggtcgggcggcacaaccttggcatcttgatcgcccagaacatggcggtggtgcccatgatgctggtgctggaattcctcgrgaccaagcggctgttgcccgccgacatggccc
